United States Patent 9,493,785 (ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY) - sequence listing, part 3

SEQ ID NO: 4380 - DNA, 1696 bp, Lotus japonicus
tttgtttcagaaaccacacacatcttcaccggcaattgaaaaatcgccatggctacctcctccattgcaagcctcaactcaccttcaaggttgctttccattccaaaagagccatacccatcttcccatttctcctcaaacctgctcaagtttgcagctcccagaaccccttcttcttctgtctcctgctccctcacaagagaccctgcctctgttcttccactggagcaacgcgtcgagctcaacaatggggcgcttctgcatcagagacctgattcatttggcaggtttgggaagtttggtggcaagtatgtccctgaaactctaatgcacgctctcaccgagcttgaggcggcgtttcattccctcactgctgatgaggattttcagagagagctggctggaattctaaaagattatgttggtcgggagagtcctctttattttgcagaaaggttgacagagcactacaagaggcctaatggtgaagggcctcacatttatctgaagagggaagatcttaatcacaccggggctcacaaaattaacaatgctgttgcccaggctttgcttgccaagagtttaggcaagaaacgcattattgctgaaactggagccggtcagcatggagttgccactgcaactgtatgtgctcgatttggtctagaatgcattatttatatgggtgcacaggatatggaaaggcaggcactcaatgttttcaggatgcgtcttcttggtgctgaggtgagacctgtccatgccgggactgccactctcaaggatgctacatcagaggctataagggactgggtgactaatgtagagactactcattatattttgggttctgtggctgggccgcatccatatccaatgatggtaagggagtttcatgctgtgattggcaaggaaaccagaaagcaagctttggaaaaatggggagggctaccagatgtcctgattgcttgtgttggtggaggttcaaacgccatgggacttttccatgaatttgttgatgacaaagatgttaggctaattggtgtggaggctgctggatttggcctggacagtggcaagcatgctgcgacattaacgaagggagaagttggggttttgcatggagctatgagctatttgcttcaggatgatgatggccaaatagtcgagcctcactctatcagtgcaggcttggactaccctggcgttggacctgaacatagctttttgaaggatttagggcgtgctgaatattatagcatcactgatgaagaagcattggaagctttcaagagagtttcacgacttgaaggcataattccagctctggagacatctcatgcgttggcatacctagagaaagtgtgtccaacccttcctaatggaaccaaggttgtgcttaacttcagtggccgaggtgataaggatgttcaaactgctatcaagtacttgaaggtttgaaatttgagtagttcatgttcttgtgtagaccagtgttttagctcttgaatagacttcattttcatactattttaattaagagacaggataaggttgagttttactgtgctaaatcaagtggttaaagaaccattgtatattttgggtcacagaactgcggctattcaatatgtaatgtacttctgttttgaataacacgataaaatgtggtgaatgcaatgacaacctgctgtgg

SEQ ID NO: 4381 - DNA, 1707 bp, Glycine max
atggctgcttcaataccattcacaggtctcaactcctcaagggtgcttcccattcccaaagagccataccacccattttcccatttcccctcaagcatgccaaagtttgcatctttgagaatcccttcttcttctgtgtcttgctctctcacaagagactcttcctctgttgtgccattggaggaacatgacaaaatgggtaatgggtcggttctgcttcagagacccgattcgtttgggaggtttggcaagtttggagggaagtatgtccctgagactctgatgcatgctctctctcagcttgaggctgccttttattccctcgctgctgatgaagagtttcagacagaactggctgggattctaaaagattatgttggccgggagagtcctctttattttgctgaaaggttgacggagcattacaagaggcctaatggtgaaggacctcacatttatctgaagagggaagatctcaatcacactggggctcacaaaattaataatgctgttgctcaagctttgcttgctaagagattgggcaaaaaacgcattattgctgaaactggagcgggtcagcatggagttgccactgctactgtatgtgctcgatttggtttagaatgcattatttatatgggtgcgcaggatatggaaaggcaggctctcaatgttttcagaatgcgtcttctcggtgctgaggtgagaccagtccattctgggactgctacacttaaggatgcgacatcagaggctataagggactgggtgactaatgtggagacaactcattatattttggggtctgttgctgggccgcatccatatccaatgatggtaagagagtttcatgctgtgattggcaaggagaccagaaagcaagctttggagaagtggggagggaaaccagatgtcttgattgcatgtgttggtggaggttcaaatgccataggacttttcaatgaatttgttgatgacaaagatgtaaggctaattggtgtggaggctgctggatttggcctggacagcggcaagcatgctgcaaccttaacaaaaggagaagttggggttttgcatggagctatgagctatctgctgcaggatgatgatggacaaatagttgagcctcactctattagtgcaggcttggactaccctggtgtgggtccggaacatagctttttgaaagatttagggcgtgctgaatatcatagtatcacagatgaagaagcattggaagcttttaagagagtttcgcgacttgaaggcataattcctgcactggaaacatctcatgcattggcatatctagagaaagtgtgtccaacccttgctaatggagccaaggttgtggttaacttcagtggccggggtgataaggatgttcaaactgctatcaagtacttgaagctttgaaaggatcaaaacttgctgagtgagcttcattttcatacttagagacataattaatacaatttattattagaccaagttaaatagtcatgtatatttgcatcagagaactgttgctattcaatcctcaataaacttagtttatgttataataaaatttgtggctgaatgcaataaaatcttatctgcaagaagcttatagaggcaaacaagtttggtgtgtttgttgagagctagagagtggtttgactttgaaagttgacaatggaaataaactaaaggcccgtttgttac

SEQ ID NO: 4382 - DNA, 1854 bp, Glycine max
aaatccaattgaaatcaaaaataaaaaggaaaaaagaaaaagtaaagacctctcaacacatggctgcttcaatcccatttacaggtatcaactcctcaagggtgcttcccattcctagagaaccacaccacccattttcccatttgctctcaaacatgtcaaagtttgcatctttgagaaccccttcttcttcttctgcttcttcttcttcttcttctgtgtcttgctctctcaccaaagacccttactctgttgtgccattggaggaacatagcaaaatggataatgggtcggttctgcttcagagacccgattcgtttgggaggtttggcaagtttggagggaagtatgtccctgagactctgatgcatgctctcactgagcttgaggctgctttttattccctctctgctgatgaagagtttcagaaagaactagctgggattctaaaagattatgttggacgggagagtcctctttattttgctgaaaggttgacggagcattacaagaggcctaatggtgaagggcctcacatttatctgaagagggaagatctcaatcacaccggggctcacaaaattaacaatgctgttgctcaagctttgcttgctaagaggttgggcaaaaaacgcattattgctgaaactggagcgggtcagcatggagttgccactgctactgtatgtgctcgatttggtttagaatgcattatttatatgggcgcacaggatatggaaaggcaggctctcaatgttttcagaatgcgtcttcttggtgctgaggtgagacccgtccattctgggactgctacactgaaggatgcgacatcagaggctataagggactgggtaactaatgtggagacaactcattatattttgggttctgttgctgggccgcatccatatccaatgatggtaagagagtttcatgctgtgattggcaaggagaccagaaagcaagctttggaaaagtggggagggaaaccagatattctgattgcatgtgttggtggaggttcaaacgccatgggacttttcaatgaatttgttgatgacaaagatgttaggctaattggcgtggaggctgctggatttggcctggacagtggcaagcacgcggcaacgttaacgaagggagaagttggggttttacatggagctatgagctacctgctgcaggatgatgatggacaaatagttgagcctcactcaattagtgcaggcttggactaccctggtgtgggtccggaacatagctttttgaaagatttagggcgtgctgaatatcatagcatcacagatgaagaagcattggaagcttttaagagagtttcgcgacttgaaggcataattccagctctggaaacatctcatgcgttggcatatctagagaaagtgtgtccaacccttcctaatggagccaaggttgtggttaacttcagtggccggggtgataaggatgttcaaactgctatcaagtgcttgaagctttgaaagggttgtcatgaacttgtgtggagctgtggattggctgctgactgagctttattttcatacttatgagacataattaatacaatttatcattagaccaagttaaataatcatgtatatttgtatcagagaactgttgctattcaatcctcaatcaacttagttttatgttataataaaatttgtggctaaatgctgtaaaatcttatctgcaagaagcttgtagatgtaaacaagttcggtgtgtttgttgagagctatagaggtgaacaagtttgcatgtctaatgactggtttgaccttgaaagttgacgatggaaataaactaaaggcccgtttgtcacaattttttttt

SEQ ID NO: 4383 - DNA, 1779 bp, Phaseolus coccineus
gaagtttgatcccctttctgttgtcatcaaatcatagctatgaatcttgtctctgcatacagacaaaaacaccaaggaaaagaaccaaacaaaatctcaacaatctttcaccctataaattaaacccccaccaaccccaaatcaatttctttcagaacaaaagaaaaagctctctcaatcacttgaaaatggctgcttccatcccattcacaggcctcaactcctcaagggtgcttcccattcccagccagccatacccatcttcctatttcccctcaaatgtgctaaagcttgcacctttcagaaccccttctacctattcttcttctgtgtcctgttctgccaccagggacccttcctctgttgtgccattggagcaacatcacaatttggataatgggtcggttttgcccaatagacccgattcatttgggaggtttggcaagtttggcgggaagtatgtccctgagactctgatgcacgcactcactgagcttgaggctgcttttcattccctctctgcagatgagcagtttcagaaagagctggctgggatcctgaaagattatgtgggtcgagagagtcctctttattttgcagaaaggttgacagagcactataagaggcctaatggtgaagggcctcacatttatctgaagagggaagatctcaatcatactggtgctcacaaaattaacaatgctgttgctcaagctttgcttgcgaagagtttgggaaaaaagcgcataattgctgaaactggagctggtcagcatggagttgccactgctactgtatgtgctcgatttggtttggaatgcattatttatatgggcgcacaggatatggaaagacagtctctcaatgttttcagaatgcgtctccttggtgctgaggtgagagcagttcactctgggactgctactctcaaggatgctacgtcagaggctataagggactgggtgactaatgtagagacgactcattatattttgggttctgttgctgggccgcatccatatccaatgatggttagagattttcatgctgtgattggcaaggagaccagaaagcaagctttggaaaaatggggagggaaaccagatgttctgattgcatgtattggtggggggtcaaatgccatgggacttttcactgaatttgttgatgacaaagatgttacgctaattggtgtggaggctgctggatttggtctagacagtggcaagcatgctgcaactttaacaaagggagaagttggggttttgcatggagctatgagctatctgttgcaggatgatgatggacaaatagttgagcctcactctattagtgcaggcttggactatcctggtgtgggtccggaacatagctttttgaaagatttgggacgtgctgaatatcatagcatcactgacaaagaagcattggaagctttcaagagagtttcacgacttgaaggcataattccagctttggaaacatctcatgcattggcctatctagagaaagtgtgtccaaccccttcccaatggaaccaaggttggtggttaacttcagtggtaggggtgacaaggatgttcagactgccatcaagtacttggatgtttgaaagggtcatcatgtcatgtggaatgggtactgaagtgagcttacataatagagagacataattaatataatttatttttagaccaagttaaataacaatgtatatttgcatcagaaaactgttgctattcaatcctcaataataatcttggtttatgttattataat

SEQ ID NO: 4384 - DNA, 1841 bp, Arachis hypogaea
ggggatacaaaatcatcaaatctcacacaaaccatatataaattccaaatacccaaaaaaccattctcagttctcagaaaatcttcaaaaccatggcttcctccatcacaagctcttcttcaaggttgtttcccattaccagagaatcacaacccacttcccattccaccttaaacttttcaaagtttgcatctttttcttcttcttcttcttcagcttcaggttccaaagcctcctcttatatctcttgctctctcaccagggacccttctgttctgccattggaggagcagtcaaagctctctaatgggtcagttctctttcagagaccagattcccttgggaggtttggaaagtttggtgggaaatatgtccctgagactctaatccatgccctcaccgagcttgaggctgcatttcattccctttctgctgatgaagattttcagaaagagctggctggtattcttagagattatgttggtcgagagagtcctctttattttgcagaaaggttgacagagcattataagagggcgaatggtgaagggcctcatatttacctaaagagggaagatcttaatcacactggtgctcataagatcaataatgctgttgctcaagctttgcttgccaagtgtttggggaaaaaacgaattattgctgaaactggagctggccagcatggtgtcgcaactgctactgtatgcgctcgatttggtttggaatgcattgtttatatgggggcacaggacatggaaaggcaggctctgaatgtcttcagaatgcgtcttctcggtgctgaggtgagaccggttcattctggaactgccacacttaaggatgctacatcagaggctataagggattgggtgacaaatgtggagacaactcattatattttgggttcggttgctgggccgcatccatatccaatgatggtaagagagttccatgccgtgattggcaaggaaaccagaaaacaagcgttggaaaaatggggagggaaaccggatgttctgattgcatgtgtcggaggaggttcaaatgccatgggacttttccatgaatttgtcgatgacaaagacgttagactaattggcgtggaagctgctggatttggcttggacagtggcaagcatgctgcgacattaacaaagggagaagttggggttctgcatggagctatgagttatctgctgcaggatgatgatggacaaattgtcgagcctcactcaattagtgcaggcttggactaccctggtgtaggaccggaacatagctttttgaaagatattgggcgcgctgaatattatagcatcactgatgaagaagcactagaagctttcaagagagtttcgcgtctcgaaggcataattccggctctagagacatctcatgctttggcctatctggagaaagtgtgtccaactcttcctaatggcgccaaagttgtggtcaacttcagtggcagaggtgacaaggatgttcataccgccatcaagtacttgaaggtttgaaagtgtcgcgttgttctgtagaccaatggtttagcttctgaaatgggcttcatttttcatacttatagttattgaattggttcaattttctcgttaaatccaagttatagttaaaaacgttcatatatatcgatatattttcatcataggactatggctataatgtgtgtaatgaactactttcaatgttagatgcaatcaaagtctttcatggactcttctgaatgttcttataccattgaatcatttgatgaatttgatatcagcatataaggttggaaaatggtgtaaaatagatcttcttagcacataattaaactc

SEQ ID NO: 4385 - DNA, 1758 bp, Prunus persica
tctcgtaaaaaaacctcctccataaaatggcagcctccacaagcgcttccaccacttgcaaaacccaccgactgatcaccccgccgcttccaaaaccctactcctcctcccaattgtccttcaagttccacaaatttaccccccgtgccaccaccccttcttccatctcctgcaccctcacccgagattcagcccctcttcagatggaggacaagcacgaaaatgggtccttaccggttctgccccgacccgattccttcggccggttcggtaagtatggcggcaagtacgtccccgaaaccctaatgcatgccctcaccgagctcgaggctgcttttcatgctcttgctaatgacgaggactttcagaaagaattgaatggcattttgaaggactatgttggcagggagactcctctctactttgcagagcggctaactgagcactacaaacgccctaatggtgaagggcctcacgtttatctgaagagggaagatcttaaccatactggggcccataagatcaacaatgccgttgcccaagccttgcttgctaagaaattgggaaagaaacgcattattgctgaaactggagcgggtcaacatggagttgccactgccactgtttgtgctcggtttggattgcagtgtatcatctacatgggtgcccaagatatggaaaggcaatccctcaatgttttcagaatgcggcttcttggagcagaggttagaccagtccattctgggacagctacattgaaggatgctacttcagaagctataagggactgggtaactaatgtagagacaactcattatattttgggttccgttgctggcccacatccataccctatgatggttcgggatttccacaaggtgattggtagagaaacaagaaaacaggcactggaaaagtggggagggaaaccagatgtgctggtagcttgtgttggtgggggttcaaatgccatgggacttttccatgagtttgtcgaagacaaagatgttcgattgattggggtggaggctgcaggctttggattggacagtggaaagcatgctgcaactttgacaaaaggggaagtaggggtcttgcatggagctatgagctacttattgcaggatgacgatggacaaattgttgagcctcattctataagtgcaggcctggattaccctggagttggtccagagcacagttttctgaaagacacacagcgtgctgaatactatagcattactgatgaagaagccttggaagcttttaaacgattgtcaagactggagggaataattccagctttggagacttctcatgcactggcctacttagagaagctgtgccctacactccccgacggggccaaggttgtgcttaactgcagtggcagaggggataaggatgttcacactgccatcaagcacttgaaggtctgatgccaccatgattgagcaaaaccaaaggatcgtctctctccagaaagctaaaggaaccataggaaataaattttattatttccataatgtgtctattaaatcacccgttatagagcaagtttggaaatgcaatttgctgataagtcaaggatggctccaacgaataaaagtggaataccagtttttgtaatgatgtaagtttcttcgtttttcctgtataatgtaactttatgaatttcaatgaggagactgcaaatctggttatatctgaatatttatgacgaatcgctattgcgaaggttttgctcaatttcttcag

SEQ ID NO: 4386 - DNA, 1674 bp, Aquilegia formosa
gtaaatactaaaattgctttgccccctcctttcaatatcttcccaaattctcaccgcttattacatttacatctctctctttaaaccaaaaaatctttgtgatttctgaacaacccctttcaatggcaatctctaatactattgcatcttcatcttcaccatcttcttttactacccttcgaagaccttgcaaatttcatcaataccctttgttttcctattcttctattaaacgttcttctttttcttccatttcttgtagtcttaccaaagcttcatctttacaaatggaggcggctaattcgactatttcacaaaggcctgattcttttggaaggtttggtaaatttgggggcaaatatgttcctgaaactttaatgtatgctctttctgaacttgaatctgcatttcgattgcttgctagtgatgaagcttttcagaaagaattgaatgggattttgaaagactatgttggaagggagagtcctctgtattttgccgagagattaacagagcattataagcgtccaaatgatgagggtccactcatatacctaaaaagagaagatctcaaccacactggagcccataagattaataatgctgttgctcaagcattgcttgccaagcggttgggaaagaaacggatcattgctgagacaggagctggtcaacatggagttgctactgctactgtatgtgctagatttgggttggagtgtatcatttacatgggggcccaagatatggagagacagtctctcaatgttttcagaatgcggcttcttggagctgaggtgagaccagtccattcagggacagccacactgaaggatgcaacatcagaagctataagggattgggtaactaatgtagagtcaactcattatattctggggtctgttgcgggcccccatccatatcccatgatggtcagggaattccatgctgtgataggcaaagaaacaaggaaacaagccattgagaaatggggtggaaagccagatgtgctagttgcttgtgttgggggtggttcaaatgcaatgggactcttccatgagtttgttgatgatgcagatgtgaggttgatcggcgtggaagccgctggtcatggtgtggatagtggcaagcatgctgccactttgacaaaaggagaggtgggggttcttcatggtgctatgagctatctattgcaggatgatgatggacagataattgaacctcattctattagtgctgggttggattatcctggagttggacctgagcacagctttctgaaagacctaggacgagcagaatactacagtgtcacagataatgaggcactggaagctttcaagagagtatctcgtctagagggtataataccagcactggagacatcacatgcccttgcgtacttggagaagctgtgccctactttaccaaatggaaccaaagttgttcttaacttcagtggcagaggagataaggatgttcaaaccgccattaagtatttggaggtctaaaggaagggtatgagcatcgaattatgatgaatttggatccattatgttgtttttgtggtggaaactgttgtcagtaggaaaaaaggccatgtaagttactgttgtttgtttcaaataaattttgttgcatatttgagtttgtttgtaattaataatcagagca

SEQ ID NO: 4387 - DNA, 1592 bp, Aquilegia formosa
aaaccaaaaaatctttgtgatttctgaacaacccctttcaatggcaatctctaatactattgcatcttcatcttcaccatcttcttttactacccttcgaagaccttgcaaatttcatcaataccctttgttttcctattcttctattaaacgttcttctttttcttccatttcttgtagtcttaccaaagcttcatctttacaaatggaggcggctaattcgactatttcacaaaggcctgattcttttggaaggtttggtaaatttgggggcaaatatgttcctgaaactttaatgtatgctctttctgaacttgaatctgcatttcgattgcttgctagtgatgaagcttttcagaaagaattgaatgggattttgaaagactatgttggaagggagagtcctctgtattttgccgagagattaacagagcattataagcgtccaaatgatgagggtccactcatatacctaaaaagagaagatctcaaccacactggagcccataagattaataatgctgttgctcaagcattgcttgccaagcggttgggaaagaaacggatcattgctgagacaggagctggtcaacatggagttgctactgctactgtatgtgctagatttgggttggagtgtatcatttacatgggggcccaagatatggagagacagtctctcaatgttttcagaatgcggcttcttggagctgaggtgagaccagtccattcagggacagccacactgaaggatgcaacatcagaagctataagggattgggtaactaatgtagagtcaactcattatattctggggtctgttgcgggcccccatccatatcccatgatggtcagggaattccatgctgtgataggcaaagaaacaaggaaacaagccattgagaaatggggtggaaagccagatgtgctagttgcttgtgttgggggtggttcaaatgcaatgggactcttccatgagtttgttgatgatgcagatgtgaggttgatcggcgtggaagccgctggtcatggtgtggatagtggcaagcatgctgccactttgacaaaaggagaggtgggggttcttcatggtgctatgagctatctattgcaggatgatgatggacagataattgaacctcattctattagtgctgggttggattatcctggagttggacctgagcacagctttctgaaagacctaggacgagcagaatactacagtgtcacagataatgaggcactggaagctttcaagagagtatctcgtctagagggtataataccagcactggagacatcacatgcccttgcgtacttggagaagctgtgccctactttaccaaatggaaccaaagttgttcttaacttcagtggcagaggagataaggatgttcaaaccgccattaagtatttggaggtctaaaggaagggtatgagcatcgaattatgatgaatttggatccattatgttgtttttgtggtggaaactgttgtcagtaggaaaaaaggccatgtaagttactgttgtttgtttcaaataaattttgttgcatatttgagtttgtttgtaattaataatcagagca

SEQ ID NO: 4388 - DNA, 1572 bp, Solanum phureja
tttaaaaacttttcatccaaacatggccttctcctccaccgtatctccgaaacattgccgcctctcttctgccgcttcctcctcctcccactttcctaaattccaaatacccctccaactcaacaaaattacaccttgccactcttcctcctcgaagtttcctccttccattgtttgtgttcttacagaaaaacaatcaatggcggctcaggcggttgatgaaccggcggctattcaacgtcccgattcgttcggccgatttggaaaatttggtggaaaatacgtgcctgaaactctaatgcacgcactcgatgagctcgagacagctttcaaatcactcgctaccgatgaagcttttcagaaagagctagatggaatattaagagattatgtaggcagagagagccctctttattttgcagagcgacttactgagcactacaaacgcccaaatggcgaagggccactgatctacttgaaaagggaggatcttaaccacactggtgcccacaaaattaataatgcagttgcccaagctttgcttgctaagcgcttgggcaagaaacgcatcattgctgagacaggggcaggtcagcatggtgttgccactgctactgtttgtgctcgttttggtttggaatgcattatctatatgggtgcccaagatatggagagacaagcactaaacgtcttcagaatgcggctgcttggagctgaggttagagcagttcactctgggactgctacactcaaggatgccacttcagaggctataagggattgggttacaaatgttgagacaactcattacatacttggatctgttgcaggcccacatccgtaccccatgatggtaagagacttccatgcggtgattggcaaagaaacaaggaagcaagcattagaaaaatggggtgggaaaccagacgtgcttgttgcatgtattggtggaggctcaaatgctatgggactgttccatgagtttgttgatgatgacaatgttaggttgattggggtagaagctgctggttttggtatagatagtggaaaacatgctgcaactttgacaaagggagaggttggagtactgcatggagctatgagctatctgctgcaagatgaagacggacaaatagttgagccccattctatcagcgctggactggattaccctggagttgggccagagcatagctttttgaaagacttaggacgagcagagtattatagcattactgatgaggaggctttagaagccttcaagcgattgtctcggttagagggcattattcctgcactggaaacatctcatgcactggcttacttggagaagttgtgtcctactctacccaatggaactaggttggtgcttaactgcagtggcagaggagataaagatgttcagacagctattaagtatttgaaggtttaatttgaatcctttttggattcactttgtactttaggaaactgagtgaaacaagtttgttgtattggtaaaatatgcccattctgatgaataaaacatttttcttgttagtttttattggagcccttggttcaaaaaccccg

SEQ ID NO: 4389 - DNA, 1564 bp, Solanum lycopersicum
atttaaaacttttcatccaaacatggccttctcctccaccgtatctccgaaacattgccgcctttcctccgccgcttcctcctcctcctcctttcctaaattccaaatacccctcaaaatcaacaacattacaccttgccactcctcctcaaagtttcctccttccattgtctgtgttcttacagaaaagcaatcaatggcggctcaggcggttgatgaaccggcggctattcaacgtcccgattcgttcggccgattcggaaaatttggggggaaatacgtgcctgaaactctaatgcacgcacttgatgagctcgagacagctttcaaatcactcgctaccgatgaagcttttcagaaagagctagatggaatattaagagattatgtaggcagagagagtcccctttattttgcagagcgacttactgagcactacaaacgtccgaatggcgaagggccactgatctacttgaaaagggaggatcttaaccacactggtgcccacaaaattaataatgcggttgcccaagctttgcttgccaagcgcttgggcaagaaacgcatcattgctgagacgggggcaggtcagcatggtgttgccactgctactgtttgtgctcgttttggtttggaatgcattatctatatgggtgcgcaagatatggagagacaagcactaaacgtcttcagaatgcgcctgcttggagctgaggttagagcagttcactctgggactgctacactcaaggatgccacttcagaggctataagggattgggttacaaatgttgagacaactcattacatacttggatctgttgcaggcccgcatccgtaccccatgatggtaagagacttccatgcagtgattggcaaagaaacaaggaagcaagcattggaaaaatgggatgggaaaccagacgtgcttgtcgcatgtattggtggaggctcaaatgctatgggactgttccatgagtttgttgatgatgaagatgttaggttgattggggtagaagctgccggttttggtgttgatagtggaaaacatgctgcaactttgacaaagggagaggttggagtactgcatggagctatgagctacctgctgcaagatgaagatggacaaatagttgagccccattctatcagcgctggactggattaccctggagttggtccagagcatagctttttgaaagacttaggacgggcagagtattatagcattactgatgaggaggctttagaagccttcaagcgattgtctcggttagagggcattattcctgcactggaaacatctcatgcactggcttacttggagaagttgtgccctactctacccaatggaactagggtggtgcttaactgcagtggcagaggagataaagatgttcagacagctattaagtatttgaaggtttaatttgaatccattttggattcattttgtactttaggtaactgagtgaaacaaatttgttgtattggtaaaaaatatgcccattctgatgaataaaacatttttcttgtaagtttatattggatctgcttgttcaca

SEQ ID NO: 4390 - DNA, 1528 bp, Capsicum annuum
ggcacgaggtttttaaaaaaataaaaatcaatttttatccaaacatggccttctcctccaccgtatctcccaaacatcaccgtctctcttccgccgccggcggcggctccgccttacctaacaatttccaaatacctctaaaactcaacaaaattacacttttgccatcctctttaaagcctccgtgttctattacttgtgttcttacggaaaagcaatcaatggcggcggctgaaccggcgccggttcatcaacgtcccgattcgtttggccggttcggtaaatttggcgggaaatacgtaccggaaacgctaatgcacgcgcttcatgagcttgaaattgctttcaattcactcgctaacgatgaagcttttcagaaagagctagatggaatattaagagattatgttggcagagagagccctctttattttgcagagcgacttaccgagcactacaaacgtccagatggtgaagggccactgatctacctgaaaagggaagatcttaaccacactggtgcccacaaaatcaataatgccatcgcccaagctttgcttgccaagcgcttgggcaagaaacgcatcattgctgagacaggtgcaggtcagcatggtgttgccaccgctactgtttgtgctcgttttggtttggaatgcgttatctatatgggtgcccaagatatggagagacaagcactaaacgtcttcagaatgcgtctacttggagctgaggttagagcagtccactctgggactgctaccctcaaggatgccacttcagaggctataagggattgggttacaaatgttgagacaactcattacatacttggatctgttgcaggcacacatccgtaccccatgatggtaagagagttccatgcggtgattggtaaagaaacaaggaagcaagcattggtaaatggggtgggaaaccagacgtgcttgttgcatgtgttggtggaggatcaaatgctataggactattccatgagtttgttgatgataaagatgttcggttgattggggtagaagctgccggttttggtatagatagcggaaaacatgctgcaactctgacaaagggagaggtgggagtactgcacggagccatgagctatctgctgcaagatgaagacggacagatagttgagccccattctatcagtgccggattggattaccctggagttgggccagagcacagctttttgaaagacttgggacgagcagagtattatagcattaccgatgaagaggctttagaagccttcaagcgattgtctcggttagagggcattatccctgcactcgaaacatctcatgcactggcttacttggagaagttatgtcctaccctaccccatggaactagggtggttctcaactgcagtggcagaggagataaagatgttcaaacagctatcaagtatttgaaagtttaatttgaatcccctttaggtggagattcattttgtactttagaaaactgaatgaaacaagtctgttgtattagttaaaaaaaa

SEQ ID NO: 4391 - DNA, 1805 bp, Gossypium hirsutum
aaagaaacagtccacccaaataaagccctaaaattgaaatgccctcgaatatggccgccaccgccacaagcaccgccacattccgtcttggcaatcccctttcctcttcctctttctcttcctcatccgtttactcctccaagaaattgcctgtcaatttcagaaaatttgcgcttcagacgtcgcctgtgaaaagcttttctgtttcttgtactctaactagaaaaccagtcccagctgctccggtttccatggattcggacccgaacggatggcaacgacccgactcgtttggtcggtttggcaaatttggcggcaaatacgttcccgagaccctaatgtctgccctctctgagctggatgcggcttttcattccctctccaaagatgaaaaattccaggaagaattagctgggattttgaaagactatgttggtagggaaagtccactttattttgcagagcggctgtctgaacattacaagcgtcccaatggtgaagggccagatatataccttaagagggaggatcttaaccatactggtgctcataagatcaataatgctgttgctcaggcattgcttgctaaacgtttgggcaagaaacggattattgctgaaactggagctggtcagcatggagtggcaacagctaccgtgtgtgcacggtttggtttgcagtgcattatttacatgggtgctcaagatatggaaagacaggcgcttaatgttttcagaatgcggcttcttggtgcagaggttagagcagttcactcgggtactgcaacactaaaagatgctacatcggaagctatccgggattgggtgactaacgtggagacaactcattatattttgggatctgttgctggtccacatccatatcctatgatggtgagagagttccatgcagtgattggtaaagaaacaagaaaacaggccctggaaaaatggggagggaaaccagatgtattggttgcatgtgttggcggaggttcaaatgctatgggacttttccatgagtttgttaatgacaaggatgttaggttgattggtgtagaggctgctggttttggtttggacagtggcaagcatgctgctactttgaccaagggagaagtgggagttttgcatggagctatgtcctacttattacaagatgaagatgggcaaatagttgaaccccattccattagtgcaggcttggattatcctggggttggaccagaacacagttttctgaaagatgtagggcgagctgagtaccacagtgtcacagatgaagaagcattggaagctttcaagagattgtctcgactggagggtataatcccagctttggagacatctcatgcactggcttatttggagcagctgtgtccaactctaccgaatgataccaaagttgtggttaactgcagcggcagaggcgataaagatgttcagacagtgattaagcatttgcaggtatgattacgatgcttttcgtggaaataaatggttgccctttctttctacaaccatgctgtcagtctttttctctgtttctttatatgtactactacttgctttgcaaaacatttgtaatggggaatccttctgccaacatttgtaatggggaatcattctgccaacttatgataaaatagtttagggcctttaggcctgctctatggtgcagttaattaaattttcagagcgatggctcatatcgcgatccactatccctaaattgaacgccaccccggagcgacgctccaacttttgtttcctttacccatgaataattgccaactgggcgatatg

SEQ ID NO: 4392 - DNA, 1752 bp, Gossypium hirsutum
  misc_feature (688)..(688): n is a, c, g, or t
aaacagtccacccaaataaagccctaaaattgaaatgccctcgaatatggccgccaccgccacaagcaccgccacattccgtcttggcaatcccctttcctcttcctcttcctcatccgtttactcctccaagaaattgcctgtcaatttcagaaaatttgcgcttcagacgtcgcctgtgaaaagcttttctgtttcttgtactctaactagaaaaccagtcccagctgctccggtttccatggattcggacccgaacggatggcaacgacccgactcgtttggtcggtttggcaaatttggcggcaaatacgttcccgagaccctaatgtctgccctctctgagctggatgcggcttttcattccctctccaaagatgaaaaattccaggaagaattagctgggattttgaaagactatgttggtagggaaagtccactttattttgcagagcggctgtctgaacattacaagcgtccgaatggtgaagggccagatatataccttaagagggaggatcttaaccatactggtgctcataagatcaataatgctgttgctcaggcattgcttgctaaacgtttgggaaagaaacgggttattgctgaaactggagctggtcagcatggagtggcaacagctaccgtgtgtgcacgatttggtttgcagtgcattatttacatgggngctcaagatatggaaagacaggcgcttaatgttttcagaatgcggcttcttggtgcagaggttagagcagttcactcgggtacggcaacactaaaagatgctacatcggaagctatccgggattgggtgactaacgtggagacaactcattatattttgggatctgttgctggtccacatccatatcctatgatggtgagagagttccatgcagtgattggtaaagaaacaagaaaacaggccctggaaaaatggggagggaaaccagatgtattggttgcatgtgttggaggaggttcaaatgctatgggacttttccatgagtttgttaatgacaaggatgttaggttgattggtgtagaggctgctggttttggtgtggacagtggcaagcatgctgctactttgaccaagggagaagtgggagttttgcatggagctatgtcctacttattacaagatgaagatgggcaaataatcgaaccccattccattagtgcaggcttggattatcctggggttggaccagaacacagttttctgaaagacgtagggcgagctgagtaccacagtgtcacagatgaagaagcattggaagctttcaagaaattatctcgactggagggcataatcccagctttggagacatctcatgcactggcttatttggagaagctgtgtcctactctaccgaatggtaccaaagttgtggttaactgcagcggcagaggcgataaagatgttcagactgtgattaagcatttgcgggtatgattacgttgtttttcgtggaaataaatggttgccccttctttctacaaccatgctgtcagtctttttctctgtttctttatatgtaccaactacttccttcgtcaaacatttgtatggaaatccttctgccaacttatgataaaacagtttagggcctttaggcctgctctatggtacaggtaagtaattttttcctttttgaaccaaaaaacaagcgtatcagccaccaagctcacagcaatcccccggaatatttcaaacgggcgggggccctctaatttcacccgggg

SEQ ID NO: 4393 - DNA, 1595 bp, Helianthus annuus
  misc_feature (79)..(79): n is a, c, g, or t
  misc_feature (93)..(93): n is a, c, g, or t
  misc_feature (277)..(277): n is a, c, g, or t
  misc_feature (454)..(454): n is a, c, g, or t
  misc_feature (713)..(713): n is a, c, g, or t
  misc_feature (1000)..(1000): n is a, c, g, or t
  misc_feature (1003)..(1003): n is a, c, g, or t
  misc_feature (1039)..(1039): n is a, c, g, or t
  misc_feature (1075)..(1075): n is a, c, g, or t
  misc_feature (1312)..(1312): n is a, c, g, or t
  misc_feature (1437)..(1437): n is a, c, g, or t
atccccaacagtaaacccccttataaaaatggcattctcttcctccaacatttacagagccaccattaccaaaccctcntcttcaccttatcncagatctaacccttcacaatcatccctcacattcactaaagcttccaccttttcacccaaatccttttcagtttcttgtgtcatgacccaacaatccaccaattcatcggctgcgccggctgaaccggcgcttctccgccctgattcgctcggccggttcggtaagtttggagggaagtatgtnccagaaactctaatgtatgctttatcggaacttgagtctgcttttcatgccctagcaaccgaccatgaatttcagaaagagttagatggcatactaaaggattatgttggtagggaaagccctctttattttgctgaacggcttacagaacactataaacgtccaaacggtgaaggnccagaaatctatctcaagagggaagatctgaaccatactggtgcacataagatcaacaatgcagtggctcaagctttgctggctaagaagctgggtaaagaacgaattattgcggaaaccggggctggccagcatggagttgcgaccgccactgtctgtgcgcggttcgggttgaaatgcattatttatatgggtgctcaagatatggaaagacaggcacttaatgtgttcagaatgaaactacttggtgcagaggttngagcggttcattctgggacagccacattgaaagatgcaacatcagaagccataagggactgggtgacgaacgttgaaacaacccattacatactgggttctgtcgcgggcccacatccctaccccatgatggtacgtgagttccatgctgtaatcggcaaagaaacaagaaaacaagccttagaaaaatggggtggaaagcccgacgtactggttgcttgtgttggtggcgggtcaaatgccatgggcctgtttcatgagtttgtcgatgataaagatgttagactnatnggtgttgaggctgcgggtttcgggctagatagcggnaaacatgcggccactttgacgaaaggtgaagttggngtgttgcatggtgcgatgagctatttgttgcaggatgatgatggacagataattgagcctcattctattagtgcggggttggattatccgggagttggacctgagcatagctttctgaaagatttaggtcgtgctgaatattatagcatcactgatgcagaagcattggaagcttttaagagactatctagactggagggcataatcccagctttggaaacatcgcacgcgcttgcntatttggagaaactatgcccaacgctaccaaacggaaccaaagttgttctcaactgcagtggaaggggcgacaaagatgttcataccgccatcaaacatttgcaggtttgaagtagtcgacctcnaagacagttggatataccagaaaacgttatgcttacattttgctttagcagttgtttttttctgttgtatcagagaataaagatttcgtaaacagtttacaatgtgaaatcagaatttgccgccctttctaatttctgaatcttttctgaatcttaaa

SEQ ID NO: 4394 - DNA, 1590 bp, Mimulus guttatus
aataataatctgaaccaaacatggccttcacagctgcttcgtcatcgtcctcagctagcaaaacccaaatctccctaaccccacattccccactcacttccatctcgccctccaaattcaacaaatttacgccgccttgccctctgaattcccgttccccgtctattcgttgtacgctcaccaaacagcacgcgatggtcgaggatcgggtcgatccggcggctcttctgcaccgacccgactcgttcggccgcttcggaaaattcggtggtaaatacgtccccgaaaccctaatgcacgccctcactcaactcgaggccgccttcagatccctcgccaccgacgatgagtttcagaaagagcttgacgggatattgagagactacgttggaagagaaaccccgctttattttgctgaacgacttaccgagcactacaaacaccctgatggtaaagggccccttatatacctcaaaagggaagaccttaatcacaccggggcccataaaatcaacaacgctgttgcccaagctttgcttgccaagcgtctgggtaagaaacgtatcatagctgaaactggagctggtcagcatggtgtcgccacagctactgtttgtgctcggtttgggttggagtgtgttatttacatgggtgctcaagatatggagagacagtctcttaacgtattcagaatgcgccttcttggtgccgaggttagggcagttcactccggcactgccacgttgaaggatgccacatccgaagctatacgcgattgggtgacgaacgtcgaatcaactcattacatactcggatctgttgccgggccccacccatatccgatgatggtaagggagttccacgcagtgattggcaaagaaacaaggaaacaggcattggacaagtggggcggcaaacctgacgtgctggttgcatgcgtcggtggaggttcaaatgcaatgggtctcttccacgaattcgttgaggacaaagacgttagattgatcggtgtggaggctgcaggttttggcctggacagtggtaagcatgctgccacgttaactaaaggagaggtgggagttcttcatggagctatgagctacttgttgcaggatgacgatgggcagataatcgagccacattctattagtgctggactggattacccgggagttggacccgagcacagctttctgaaagacattggacgggccgagtattatagcatcactgacgaagaggctttagaagcttttaagagattatctaggctagagggcattattcctgcactcgagacatctcatgcacttgcttatctggagaagctatgcccaactcttcctcatggaactaaggttgttttgaactgcagcggcagaggcgataaggacgttcagacagccattaaacatttaaagctttgatttttatttttatttttaaaaatattttagatctttttgttgcacgaataaagcctcttgtaacttaaacaataaatgatttccttggcagtctacgaaagctgtgatatgccagacagtttctccaaaatccgattaagtttaacaaactgttcgttttaat

SEQ ID NO: 4395 - DNA, 1567 bp, Mimulus guttatus
ggccttcacagcgcttcgtcatcgtcctcagctagcaaaacccaaatctccctaaccccacattccccactcacttccatctcgccctccaaattcaacaaatttacgccgccttgccctctgaattcccgttccccgtctattcgttgtacgctcaccaaacagcacgcgatggtcgaggatcgggtcgatccggcggctcttctgcaccgacccgactcgttcggccgcttcggaaaattcggtggtaaatacgtccccgaaaccctaatgcacgccctcactcaactcgaggccgccttcagatccctcgccaccgacgatgagtttcagaaagagcttgacgggatattgagagactacgttggaagagaaaccccgctttattttgctgaacgacttaccgagcactacaaacaccctgatggtaaagggccccttatatacctcaaaagggaagaccttaatcacaccggggcccataaaatcaacaacgctgttgcccaagctttgcttgccaagcgtctgggtaagaaacgtatcatagctgaaactggagctggtcagcatggtgtcgccacagctactgtttgtgctcggtttgggttggagtgtgttatttacatgggtgctcaagatatggagagacagtctcttaacgtattcagaatgcgccttcttggtgccgaggttagggcagttcactccggcactgccacgttgaaggatgccacatccgaagctatacgcgattgggtgacgaacgtcgaatcaactcattacatactcggatctgttgccgggccccacccatatccgatgatggtaagggagttccacgcagtgattggcaaagaaacaaggaaacaggcattggacaagtggggcggcaaacctgacgtgctggttgcatgcgtcggtggaggttcaaatgcaatgggtctcttccacgaattcgttgaggacaaagacgttagattgatcggtgtggaggctgcaggttttggcctggacagtggtaagcatgctgccacgttaactaaaggagaggtgggagttcttcatggagctatgagctacttgttgcaggatgacgatgggcagataatcgagccacattctattagtgctggactggattacccgggagttggacccgagcacagctttctgaaagacattggacgggccgagtattatagcatcactgacgaagaggctttagaagcttttaagagattatctaggctagagggcattattcctgcactcgagacatctcatgcacttgcttatctggagaagctatgcccaactcttcctcatggaactaaggttgttttgaactgcagcggcagaggcgataaggacgttcagacagccattaaacatttaaagctttgatttttatttttatttttaaaaatattttagatctttttgttgcacgaataaagcctcttgtaacttaaacaataaatgatttccttggcagtctacgaaagctgtgatatgccagacagtttctccaaaatccgattaagtttaacaaactgttcgttttaat

SEQ ID NO: 4396 - DNA, 1691 bp, Solanum lycopersicum
  misc_feature (1155)..(1155): n is a, c, g, or t
  misc_feature (1414)..(1414): n is a, c, g, or t
  misc_feature (1537)..(1537): n is a, c, g, or t
gccttctcctccaccgtatctccgaaacattgccgcctttcctccgccgcttcctcctcctcctcctttcctaaattccaaatacccctcaaaatcaacaacattacaccttgccactcctcctcaaagtttcctccttccattgtctgtgttcttacagaaaagcaatcaatggcggctcaggcggttgatgaaccggcggctattcaacgtcccgattcgttcggccgattcggaaaatttggggggaaatacgtgcctgaaactctaatgcacgcacttgatgagctcgagacagctttcaaatcactcgctaccgatgaagcttttcagaaagagctagatggaatattaagagattatgtaggcagagagagtcccctttattttgcagagcgacttactgagcactacaaacgtccgaatggcgaagggccactgatctacttgaaaagggaggatcttaaccacactggtgcccacaaaattaataatgcggttgcccaagctttgcttgccaagcgcttgggcaagaaacgcatcattgctgagacgggggcaggtcagcatggtgttgccactgctactgtttgtgctcgttttggtttggaatgcattatctatatgggtgcgcaagatatggagagacaagcactaaacgtcttcagaatgcgcctgcttggagctgaggttagagcagttcactctgggactgctacactcaaggatgccacttcagaggctataagggattgggttacaaatgttgagacaactcattacatacttggatctgttgcaggcccgcatccgtaccccatgatggtaagagacttccatgcagtgattggcaaagaaacaaggaagcaagcattggaaaaatggggtgggaaaccagacgtgcttgtcgcatgtattggtggaggctcaaatgctatgggactgttccatgagtttgttgatgatgaagatgttaggttgattggggtagaagctgccggttttggtgttgatagtggaaaacatgctgcaactttgacaaagggagaggttggagtactgcatggagctatgagctacctgctgcaagatgaagatggacaaatagttgagccccattctatcagcgctggactggattaccctggagttggnccagagcatagctttttgaaagacttaggacgggcagagtattatagcattactgatgaggaggctttagaagccttcaagcgattgtctcggttagagggcattattcctgcactggaaacatctcatgcactggcttacttggagaagttgtgccctactctacccaatggaactagggtggtgcttaactgcagtggcagaggagataaagatgttcagacagctattaagtatttgaaggtttaatttgaatccnttttggattcattttgtactttaggtaactgagtgaaacaaatttgttgtattggtaaaaaatatgcccattctgatgaataaaacatttttcttgtaagtttttattggatctgcttgttcnaaaaccctcctttatcccaacttgaaatatgaacaagcttacaaagatggagttgtcaatatttgtctttgtaaaatttcattttgttttacatgtttaaaaactctcttggtaccacactgttgatgctgaaacagacaaattcattgctaag

SEQ ID NO: 4397 - DNA, 1539 bp, Quercus alba
aacgcttgttcattcctataatggcatcagctgctgccgccaccaccaccaccaccacaccaacccattcttcttcttcttctattagaactcaccgtttcaagccctctatacatttgccctttaggttccgcagatttacgcccacctacccctctgcttcttcgctcgctatttcttgcactatctccacccgtgacccaccggagctccgaatggacgacaacgggtcttccaccctactccagcgacccgattcgttcggccgtttcggcaagtttggcgggaagtacgtccccgaaaccctaatgcacgccctctccgagctcgagtctgctttccatgctctcgccggtgaccacgagtttcagaaagaactgaacgggatcttgaaagactatgtagggagggagagtcctctttattttgcagagcggctgacggagcattataagcgtcccaatggtgaaggtccactcatttacctcaagagagaagatctgaatcatactggggctcacaagatcaacaatgccattgcccaagctttgcttgctaagcggttgggcaaaaagcggattattgctgaaactggagctggtcagcatggagttgcaacagcgactgtttgtgcccggtttggtttgcaatgtatcatttatatgggcgcacaagatatggagaggcaggcacttaatgtcttcagaatgcggcttcttggagctgaggttagaccagtccattctgggacagccaccctgaaagatgcaacatcagaagctattagggactgggtaacaaatgtagagacgactcattatattttgggctcggttgctggaccacatccataccccatgatggttcgagaattccacgcggtaattggtaaagaaaccagaaaacaagcactggaaaaatggggagggggaccagacgttctggtagcatgtgttggtggaggttcgaatgccattggactcttccatgagtttgtagatgacaaagatgtaaggttaattggtgtggaagctgcagggtttggattggatagtggtaagcatgctgctactttgacaaaaggggaagttggggttttgcatggagctatgagctatttattacaggatgatgatgggcaaatcattgaaccgcattccataagtgcgggcttggattatcctggagttgggccagagcacagttacttgaaagatataggacgtgctgaatattatagtgtcacagatgatgaagcattagaagctttcaagagattatctcgactagagggcataatcccagctttggagacgtctcatgcactggcttatttggagcagctctgccctactctccccaatggaactagggttgtgcttaatttaagtggcagaggggataaggatgttcaaacagctatcaagcgtttgcagctttgatggtggtgttcatgtatgcggtatgccattacaaataaactaaagaacaccctctttgtttttccttttgggttgagatgtttcagagtctactcgt

SEQ ID NO: 4398 - DNA, 1792 bp, Malus domestica
cttccgaaaccccataaatggcagcagcagcctccggtagcgcctccactacttgcaaaacccactgcctaatcgccccgccgcccgcaaaaccctactcctcctccacccaactacccttcaagttctacaaatttacctcccgcgccaccgctgcccctacttccatctcctgcactctcacccgggattctgccgctattcagatggacgagaagaaggacaacggcgccttcccggttctgcctcgccccgattcgttcggccggttcggaaagtatggcgggaaatacgtccccgagaccttaatgcacgcgctcaccgagctcgaggccgcgtttcacgctctcgctaatgacgaaggctttcagaatgaattgaatggaattttgaaggactatgttggcagggagactccactctactttgcggagcggctgactgagcactacaaacgccctaatggcgaagggcctcaggtttacctgaagagggaagatcttaaccatactggggctcataagatcaacaatgccgttgcccaggcattgcttgccaagaaattgggcaagaaacgtattattgctgagactggagcgggacaacacggtgttgccactgccacagtttgtgctcggtttggattgcagtgtatcatctatatgggtgcccaagatatggaaaggcaagccctcaatgttttcagaatgcggcttctgggggctgaggttagaccagtccattctgggacggcaacattgaaggatgctacctcagaagcgataagggactgggtgactaatgtcgagacaactcattatattttgggctctgttgctggcccacatccataccctatgatggttcgggatttccacaaggtgattggtagagaaacaagaaaacaagcactggaaaagtggggagggaagccagatgtgctggtagcttgtgttggtggaggttcaaatgccatgggactcttccatgagtttgttgacgacaaagatgtccggctgattggggtggaggctgcagggtttggattggacagtggaaagcatgctgcaactttgaccaagggggaagttggggtcttgcatggagcaatgagttacttgttacaggatgatgatggacaaattattgagcctcattctataagtgcaggcctggattaccctggagttggcccggagcatagttttctgaaagacatggggcgtgctgagtattatagcattactgatgaagaagcattggaagcttttaaacgattatcaagactggaggggataattccagctttggagacatctcatgcactggcttacttagagaagttgtgccctacgctccccgatggtgccaaggtcgtgcttaactgcagtggcagaggggataaggatgtccaaaccgccatcaagcacttgaagctttgatgttgcggccacgaatgagcaaaccaaaggaccgtcttcgtaaaagtaaaaggaccatggaaaatagaagtttcattatttcctcaaatgggtcttatgtagccacagttacagagaaagtttagaaatgcagttcgtcgtttggttgaggatgcctgttcggcatctgccaaccaaaggaagaattggcggtttcggttgtttctttgaagggaaattttgtgctacacatttcttaaataacttaagccagtttttgtaataatgcaagtttctttggttttgctgtatgatgtaacttcaataatttcaatgagaaaataaatacacagttctgttttaaaaaaaaa

SEQ ID NO: 4399 - DNA, 1691 bp, Arabidopsis thaliana
tgtgttactttgaaaggatatttcaaggagaagaatatatttgactcagagagagattcattcagtaatggcagcctcaggcacctctgctactttcagagcctccgtttcttcagctccttcctcttcttcccaattgacccatttgaaatcacccttcaaagctgtcaaatatacgcctctgccatcgtctcgctccaagtcatcatccttctccgtctcctgcaccatcgccaaggacccgcctgttctcatggccgccggatctgacccggccctgtggcaacgacccgattcgttcggtcggtttgggaagtttggtgggaagtatgtacctgaaacccttatgcacgctctatctgagcttgaatccgctttctatgctcttgccaccgacgatgatttccagagagagttggctggaatcttgaaggactatgtgggtagagaaagtcctctgtattttgcagagaggcttacggagcattacaggcgcgagaatggcgaagggcctcttatatacttgaagagagaagacttgaatcacacaggagctcacaagattaacaacgctgtggctcaggctcttcttgctaagcggttggggaagaagaggattattgctgagacaggagcgggtcaacatggtgtggctacagctactgtgtgtgcccgttttggtttggagtgtattatctatatgggtgctcaagatatggagagacaagcactcaatgtgttcagaatgcgacttcttggtgccgaggtgagaggagtccactctggaacagcgacattgaaggatgcgacatctgaagcgataagagattgggtgacaaatgtggagactacccattacatattgggatctgtggcgggtcctcatccttaccccatgatggtcagagactttcacgctgtgattggtaaagaaacaaggaaacaagcgttggagaaatggggcgggaagccggatgtcttggtggcttgtgtcggtggtggttcaaacgctatgggactcttccatgaatttgtgaatgacacagaggtccggatgatcggtgtggaagcagcgggattcggattggacagtggcaaacacgctgctacattgacaaagggagatgttggtgtcctccatggagctatgagttacttgctgcaagatgatgatggacaaatcattgaaccacactccatcagtgcaggattggactaccctggagtcggacccgagcacagtttctttaaagacatgggacgggctgaatactatagcataaccgacgaagaagcgttggaagcgttcaagagagtgtcgcggttagagggaatcattccagcactggagacctcacacgcactagcttacctcgagaagctatgtcccacattatcagacgggacgagagtggtcttgaacttcagcggaagaggagataaagatgttcagacagtggctaaatatcttgatgtttgaagagagaaacacttatgtttgtttttcagttattcagacagaatgaaatcctttttgtacttgtaatctgtttgtactttacttctctctggtcagtacgtttccaacaaaattggaaatagaaaaagattacgaagagaacgaaatttgaataaatgtattatcaataaaataaaaaacatttcatattggaaatagtcttatgttcctc

SEQ ID NO: 4400 - DNA, 1590 bp, Nicotiana benthamiana
  misc_feature (36)..(36): n is a, c, g, or t
  misc_feature (1569)..(1569): n is a, c, g, or t
gcacgaggcaacattttattgattcttatcatccancatggccttctcctcctccactgctcaaacagcttcacctctatcctccaaacattgttcccgcctatcttcctccgccgcctcctcctcctcttacttccctaaatttcaaatacccttcaaattcaacgaaattacatcttgcccttcctcaatttcctgtgtccttaccaaacaggaatcaatggcggctcgagaggctgctgaaccggcggttcccctgcgtcctgattcgtttggccggtttggtaaatttggcgggaaatacgtacctgaaaccctaatgcacgctcttgacgagctcgagaccgccttcaaattgctcgctaccgatgaagcttttcagaaagagctagatggaatattgagagattatgtaggcagagagagccctctttattttgcagagagacttactgagcactacaaacgtccagatggccaagggccattgatctacctgaagagggaggatcttaaccacactggtgcccacaaaatcaataatgcggttgcccaagctttgcttgccaagcgcttgggcaagaagcgcatcattgctgagacaggggcaggtcagcatggtgttgctactgctactgtttgtgctcgctttggtttggaatgtattatctacatgggtgctcaagatatggagagacaagcactaaatgtcttcagaatgcggcttcttggagctgaggttagaggagtccactcagggacagctacactcaaggatgccacttcagaggctataagggattgggttacaaatgttgaaacaactcattacatacttggatctgttgcaggaccacatccgtatcccatgatggtaagagagttccatgcggtgattggtaaagaaacaaggaagcaagcattggaaaaatggggcgggaagccagacgtgcttgttgcatgtgtcggtggagggtcaaatgctatgggactgtttcatgagtttgttgatgatgaagatgttaggttggttggggtagaggctgctggttttggtatagatagtggaaaacatgctgcaactttgacaaagggagaggtcggagtacttcacggagctatgagctatttgctgcaagatgaagatgggcagatagttgagccccattctatcagtgccggattggattaccctggagttgggccagagcacagctttttgaaagatttaggacgagcagagtattatagtattacggatgaggaggctttagaagccttcaaaagattgtctcggttagagggcattattcctgccctggaaacatctcatgcactggcttacttggagaagttatgtccaactctacccaatggaactaaggtggtgctcaactgcagtggcagaggagataaggatgttcatacagctatcaagtatttgaaggtttaattgaatcccttatggatctgttgttctttaggaaattgagtgaaacaattttgttgtactcgctgtactttaggaaactgagttacacaagtttattgtatggccaaatgccattntgatgaataaagattttgttt

SEQ ID NO: 4401 - DNA, 1822 bp, Arabidopsis lyrata
gccatattctcaccaacctttttttgttgttcgcaaataagttaacgtggtactgatttcctcctctatttttttttattgaatttctggtcaaaaaaaggtaagtgtcacataacgaatctataaaacaaaaccacagtttcaaggtttttgtcagcaaaacatttgtctttgagtttgagagatagataaagattcactaatggccaccgcaggcaccgctgctactttcagaccctccgtttcagcttcttccaaagcaacccgtctgagatcgccctccaaacgccccaaatttacgcctctgccatcgtctcgctcacggtcctcttcttctttttccgtctcttgcaccatcgctaaggacccgactgttttcatggcggatacggaggccgctggatctgatccgaccatgtggcaacgacccgattcattcggtcggttcgggaagtttggcgggaagtatgtccccgaaactctaatgcacgccctctctgaactcgaaacggctttctattcgctcgccaccgacgaagatttccagagagaattggcagagatcttgaaagactatgtgggtcgggaaagtcctctttactttgcagagaggctcacagagcattaccgccgagaaaacggggaaggaccgctcatatacctcaaaagggaagacttgaaccacaccggtgctcacaagatcaacaacgctgtggctcaggctcttctcgccaagcgtctaggaaagaaacggattattgctgagacaggggctggtcaacatggcgtagccacagctacagtgtgtgcacgtttcgggttgcagtgcattatctacatgggtgctcaagacatggagagacaagctcttaatgtgttcaggatgcgtcttctcggtgctgaggtaaggggagtccactctggaacagccactttaaaggacgcaacttctgaagctataagggattgggtgacaaatgtggagactacacattacatattgggatccgttgcgggtcctcatccttaccctatgatggtcagggactttcatgccgtgattggtaaagaaacaaggagacaagctatggagaaatggggcgggaagcctgatgttctggttgcttgtgtcggtggtggttcaaatgccatgggactcttccatgaatttgtcgatgacgcagaggttcggatgattggtgtggaagccgctggatttggattggacagcggcaaacacgctgccacattgacaaaaggagatgtcggtgtactccatggagctatgagttacttgctgcaagatgatgatggccaaatcattgaaccacactccatcagtgccggattggattaccctggagtcggacctgagcatagtttccttaaagacatgggacgggctgagtactatagcgttaccgatgaagaagccttagaagctttcaagagagtgtctcggttggagggaataatcccggcactagagacatcgcacgcgttggcccatctagagaagctttgtccgacgttatctgatggaaccagagtggtcttaaacttcagtgggagaggcgacaaggatgttcagactgcaatcaagtatctcgaagtttaaagagtagattactttcattttcacatagtgatatttcttctacatgtagtttgttagttcttgcttatggtcgggaatccaaaagtttggatcagagggttaaaagaagagaataaatgttatgaatgtatcctataaataataagaatgttctatggaacgtatgatgttcttataagcaattcgaactgttttgttcttgac

SEQ ID NO: 4402 - DNA, 1605 bp, Tragopogon dubius
cgatggccttctcaatgacaaccccagctcacagaaccaccgccagcccctccagctcttcttctttaccatttctcaatccatatcccttacaatcatcccttcaatcgaagaaatctgtgccccgcccacccaagtcgtttgccgtttcgtgtgtcctcgctaaacaaccaatggcggtggttaatgatgagttgtcggtcctccagcgccccgattcgttcggccgttttggtaagtatggtgggaagtatgttcctgaaaccctaatgttcgctctctccgagcttgaaaccgccttcaaagccctcgctaccgaccatgaattccagaaggaattagatgggatattgaaggactatgttggtagggaaagccctctatactttgcagaacgacttacagagcattataaacgtcccaatggtgaagggccagaaatttatcttaaaagagaagatcttaaccatacgggtgcacacaagatcaacaatgctgttgcacaagctttgttggccaagaaattagggaaagaacgaatcattgctgaaactggtgctgggcagcatggagtagcaacagcaactgtatgtgcacgatttgggttgcaatgcattatatatatgggtgctcaagatatggaaaggcaagcccttaatgtgttcagaatgaagctccttggtgctgaggtaagaccagttcattcaggaacagcaaccctaaaagatgcgacatcagaggccataagggactgggtgaccaacgtggaaacaacccattacatcttgggttcagttgcgggcccacacccgtaccccatgatggtacgagagttccatgctgtaatcggtaaagaaacacgaaaacaagcattggaaaaatggggtggaaaaccagatgttttagttgcatgtgttggtggtggatcaaatgccatggggctgtttcatgaatttgttgatgataaagaagtgagaatgattggagttgaggctgcaggttttggacttgatagtggaaaacatgctgccactttaacaaaaggagaagtgggggtgctccatggagccatgagctacttgttgcaggatgatgatggtcaaatcatcgagcctcattccattagtgcagggctggactacccaggagtgggacccgagcacagctttttgaaagatttagggcgggctgaatattatagcatcactgatgaggaagcattggaagcttttaaacgattgtcgaggttagagggcataattcctgccctagagacatctcatgcattggcttatcttgaaaaactatgcccaaccctaccgaatggcaccaaggtcgtccttaattgcagtggtagaggagacaaggacgtgcatacagccatcaaacatttgcaggtttgatgttaattaagttaatcgagggctccatcaccataagagtcgtgatattatcggaaatattatgtaatatgtatattctaataagtttggattgtaggattgtttttatgtaatttggattctatcaaaggatttggaatttgaaggattccaaattggaagcatgtttggtttttaggatttcaaatgcaagtcaatctag

SEQ ID NO: 4403 - DNA, 1789 bp, Triphysaria pusilla
ttactaaccaaaaatttactggtaacccaaacatggccttttcttcttcgttgtcgacagcctccccaactagcagaaccctaacccaccacccattgcatcgccactcgaattcgacctcgcccctcaaattcagcagatttgcacctttctgccccgctcactcgcgttgctctccaatcgcttgtaagctaaccaaaatgtcggcaacggcggtagagaaggagctcgaaacggcggtggttgccccgcagaggccggattcattcggtcgatttgggaaatttggaggtaaatacgtccccgaaaccctgatgcatgctcttacggagctcgaggatgccttcaaagcccttgccaccgatcatgaatttcagaaagagttggctggaatattgaaagactatgtcggaagagaaagcccactgtactttgctgaaagacttacggagcactacaagagctctgacggaaaaggccctctcatttacctcaagcgggaagacctgaatcacaccggggcccacaaaatcaacaatgccgttgcccaagcattgcttgcaaagcgcctcggaaagctgcgtatcattgctgaaactggtgccggtcagcacggtgttgccactgctactgtttgtgctcgatttggtctgcaatgtattatctacatgggtgctcaagatatggagagacaaaagcttaacgtcttcaggatgaggcttcttggtgctgaggttagaccagttcattccgggactgccacactcaaggatgccacgtcagaagccatacgagattgggtcactaacgttgaaactactcattacatactcggatctgttgccgggccccacccgtaccctatgatggtaagggactttcatgccgtcatcggcaaagaaacaagaaaacaggccttggaaaaatggggaggcaagcctgatgtgctcgttgcgtgcgttggtggaggttcaaacgccatggggctctttcacgaatttgttgacgacgaagacgtcagacttattggcgtcgaggccgctggtttcggcttagacagtggtaaacatgctgccactttgactctaggagaggttggggttttgcatggagctatgagttacttgttgcaagatgaagatgggcaaatagtcgagccacattcaataagtgctgggcttgattatcctggagttggcccggagcatagctttctgaaggatattggacgggccgagtactatagcatcactgatgaggaagctttagaagcttttaagagactgtctaggctagagggcattatacctgcactagagacatctcacgcaatcgcttatttggagaagctatgcccaactctcccggatggagccagagttgtgttgaactgtagtggcagaggagataaagacgttcacactgccattaatcatttgaagctctgatttattagatgattttcgatggacaagtaaaaatcccttttgttgttggaactaaaaaataaaacccggggagccttatattgacgttatatatagcctatgtagggtcctttctgcagaagtgattttaaggacctttccatattatggtttcattattttggaatatttatgaaggttctctcattttgtcttgcagtttatcttcttttttcttcaataatttatttgtagtaaaaatgtggtattacagcaaacatgaagattcactcggtgcaatagttaattgccattagaaaacaaaacagattatatacataaacggatgtaactatgtttaa

SEQ ID NO: 4404 - DNA, 1597 bp, Solanum tuberosum
cctccaccgtatctccgaaacattgccgcctctcttccgccgcttcctcctcctcctactttcctaaattccaaatacccctcaaactcaacaaaattacaccttgccactcctcctcctcaaagtttcctccttccattgtttgtgttcttacagaaaaacaatcaatggcggctcaggcggttgatgaaccggcggctattcaacgtcccgattcgttcggccgatttggaaaatttggtggaaaatacgtgcctgaaactctaatgcacgcacttgatgagctcgagacagctttcaaatcactcactaccgatgaagcttttcagaaagagctagatggaatattaagagattatgtaggcagagagagccctctttattttgcagagcgacttactgagcactacaaacgcccaaatggcgaagggccactgatctacttgaaaagggaggatcttaaccacactggtgcccacaaaattaataatgcagttgcccaagctttgcttgctaagcgcttgggcaagaaacgcatcattgctgagacaggagcaggtcagcatggtgttgccactgctactgtttgtgctcgttttggtttggagtgcattatctatatgggtgcccaagatatggagagacaagcactaaacgtcttcagaatgcgcctgcttggagctgaggttagagcagttcactctgggactgctacactcaaggatgccacttcagaggctataagggattgggttacaaatgttgagacaactcattacatacttggatctgttgcaggcccacatccgtaccccatgatggtaagagacttccatgcggtgattggcaaagaaacaaggaagcaagcattagaaaaatggggtgggaaaccagacgtgcttgttgcatgtattggtggaggctcaaatgctatgggactgttccatgagtttgttgatgatgacaatgttaggttgattggggtagaagctgccggttttggtatagatagtggaaaacatgctgcaactttgacaaagggagaggttggagtactgcatggagctatgagctatctgctgcaagatgaagacggacaaatagttgagccccattctatcagcgctggactggattaccctggagttgggccagagcatagctttttgaaagacttaggacgagcagagtattatagcattactgatgaggaggctttagaagccttcaagcgattgtctcggttagagggcattattcctgcactggaaacatctcatgcactggcttacttggagaagttgtgtcctactctacccaatggaactaggttggtgcttaactgcagtggcagaggagataaagatgttcagacagctattaagtatttgaaggtttaatttgaatcctttttggattcactttgtactttaggaaactgagtgaaacaagtttgttgtattggtaaaatatgcccattctgatgaataaaacatttttcttgttagtttttattggagcccttggttcaaaaccccggtgtcgttcccgcatatccccttccccctttatcctgacttgaaatatgaacaagctt

SEQ ID NO: 4405 - DNA, 1599 bp, Solanum tuberosum
cctccaccgtatctccgaaacattgccgcctctcttccgccgcttcctcctcctcctactttcctaaattccaaatacccctcaaactcaacaaaattacaccttgccactcctcctcctcaaagtttcctccttccattgtttgtgttcttacagaaaaacaatcaatggcggctcaggcggttgatgaaccggcggctattcaacgtcccgattcgttcggccgatttggaaaatttggtggaaaatacgtgcctgaaactctaatgcacgcacttgatgagctcgagacagctttcaaatcactcactaccgatgaagcttttcagaaagagctagatggaatattaagagattatgtaggcagagagagccctctttattttgcagagcgacttactgagcactacaaacgcccaaatggcgaagggccactgatctacttgaaaagggaggatcttaaccacactggtgcccacaaaattaataatgcagttgcccaagctttgcttgctaagcgcttgggcaagaaacgcatcattgctgagacaggagcaggtcagcatggtgttgccactgctactgtttgtgctcgttttggtttggagtgcattatctatatgggtgcccaagatatggagagacaagcactaaacgtcttcagaatgcgcctgcttggagctgaggttagagcagttcactctgggactgctacactcaaggatgccacttcagaggctataagggattgggttacaaatgttgagacaactcattacatacttggatctgttgcaggcccacatccgtaccccatgatggtaagagacttccatgcggtgattggcaaagaaacaaggaagcaagcattagaaaaatggggtgggaaaccagacgtgcttgttgcatgtattggtggaggctcaaatgctatgggactgttccatgagtttgttgatgatgacaatgttaggttgattggggtagaagctgccggttttggtatagatagtggaaaacatgctgcaactttgacaaagggagaggttggagtactgcatggagctatgagctatctgctgcaagatgaagacggacaaatagttgagccccattctatcagcgctggactggattaccctggagttgggccagagcatagctttttgaaagacttaggacgagcagagtattatagcattactgatgaggaggctttagaagccttcaagcgattgtctcggttagagggcattattcctgcactggaaacatctcatgcactggcttacttggagaagttgtgtcctactctacccaatggaactaggttggtgcttaactgcagtggcagaggagataaagatgttcagacagctattaagtatttgaaggtttaatttgaatcctttttggattcactttgtactttaggaaactgagtgaaacaagtttgttgtattggtaaaatatgcccattctgatgaataaaacatttttcttgttagtttttattggagcccttggttcaaaaccccggtgtcgttcccgcatatccccttccttctttatcctgacttgaaatatgaacaagcttac

SEQ ID NO: 4406 - DNA, 1537 bp, Quercus alba
aacacacaacttctctttctttcacttctgctcatcgctcatacttgttcaataatcaatacccacttcatttcaaggggtatagttatactacaaagtaacaaacacccacatctttttaagtaggaactgtaactggagggaacagccatggggacaaggagtcagcaattgagtcgagaggaggaggaagaggatccaccaggtcgaggtgccaccacaatttcgggccaatcagtgtcgacaagccggagtgtagggtcgccgtcgagccggagcgagcagaccatggcaacacccgccagtgacagcacttttcttagactaaaccatcttgacatccaaggggacgatgccggatcgcaaggcgctgttgctagcaagaagaaaaagagagggcaacgggctgttggaggtgataagagtggaagaggactccgtcaattcagcatgaaagtgtgcgagaaagtggaaagcaaggggagaactacttacaatgaggtagcggatgaacttgttgcggagtttgctgatccaagcaatagtgtaacgtctccagatcagcaacaatatgatgagaaaaacatccggcggagggtgtatgatgccctgaatgttctcatggcgatggatattatatctaaggataaaaaggagatacaatggaaaggtctgcctcgaactagcctgaacgatattgaagaactaaagacagagcgcctcggactcagaaatagaattgaaaagaaagctgcgtatttgcaagaactggaggaacaattcgtaggtctccagaacctgatacaacgaaatgagcaattgtacagctctggaaatgctcccagcggaggtgtggctttacctttcattctggttcagacacggccgcatgcaactgttgaggtggaaatatcagaagatatgcagctggtgcattttgacttcaacagcaccccgtttgagctccatgatgacaactatgttctgaaggcaatgaaattttgtgaaagaccacaggttgatgatatggcacacaattttactgcagatggaggtgaaggttctagcatgtcaaatatgtatcaaacgcagatacctcttcctccaatgtcaaacacaacaattaggcctcccacctcaccgcctcttcctggaatactaaaagcacgtgtcaagcatgagcattgatcaacaacaagaagtttcaacatctctccatgaacaatactctcagcatgtctgtatatttttgtaaagtaatttgccagacgttggttaggcccctaattatcatccttacctcattagattgccgtctttagaaacttcttggggttgtgcttctggcaagttgcatgtccattattcactattgtaatcacttgtcatattcttttgctgctttttggcctccaaatgtagtagaaatgactctagaggattgtccagctccataggaaattataaaatcagttctacaattggacttgtattgtatattgcattttatgtctccacttgttcaattatgttattg

SEQ ID NO: 4407 - DNA, 1775 bp, Cajanus cajan
acgcaagcacttggtccagtggttcctctcttcatcttcaacattttaggtcttctctgtttctcaggtcgatatctcaacgtcgttgatattactgagcagttcagctttacttcaaaacttttgttccatttaattcagtttcgaccagtaggatttattaccaggccttgaggtaagtgacttaccaacatgggaacacaaccccaacaaacatttcgggaggaggaggaggaggagctgccgggccgtggaaccacgatctctggtcaatcaatgtcaactagcagaagtgttggctcaccatccagccgcagtgagcagacaatggcaacaccagctagtgataacactttccttaggttaaaccatcttgatatacatggtgatgatgctggatcacagggcgcagttgctagcaagaagaaaaagaggggccaacgtgctgttggaggtgataagagtggaagaggtctccgccagtttagtatgaaagtgtgtgagaaggtagaaagcaagggaagaacaacttacaatgaggtagctgatgaacttgtggctgaatttgctgatccaagcaatggtgtttcaactcctgatcagcaacaatatgacgagaaaaacattcgtcgaagggtgtatgatgccttgaatgttctcatggcaatggatattatttctaaggataaaaaggaaatacaatggaagggtcttcctcgtactagtctaagcgatattgaagagcttaagacagagcgtcttgggctaaggaatagaattgaaaagaaagcagcctatttgcaagagctggaggagcaatatgtaggtcttcagaaacttatacaacgcaatgagcaattatatagctcaggaaacgctcccaatggaggtgtgtctttgcctttcattctggtgcagacacgcccccatgcaacagttgaagtggaaatatcagaagatatgcagcttgtgcattttgatttcaatagcactccctttgagctgcatgatgataactatgttctcaaggcaatgaaattttgtgagaggtctcagaatgataatgcaacagacaatcctacagatggcggtgaaggttctagcatgtcagggttgtaccatgcacaggttcctacttcagtttcaaaccctccaaataggactccttcatctccaccccttcctggaatattaaaggcaagaattaagaatgagcattgattgcaattttatactacattgcgttatttaagcatgtttgtaaatgttgtaaagtaatttgtcggtaattaatagtcctccataatagttaacaagtgcagccaattcactcgttaggttagaagcaaaccggtctgcttgagtctatattcttctgggttgattttggcaaattctttgctaaccatatccattaattactacctcaagaccttaactgatttccccccacatattcagtgtatttgcccttttgtacctataatagagaaattggtttgtactggtccatagagatcgtggaatgctatatacatcagcataggattaattttggaatttacagatttttgtataaattattccgtcttatgtcaatcttgatatttgggtaagtgcatcgtatgatatcctgttggactttgtgttgatagggtttcctctatgcactacttgttttattcaatatataacttcgagggaagttatttggcaaatgcttcatgcactattcttttggaaggctatcaatgaaataatccacgtatttgtgt

SEQ ID NO: 4408 - DNA, 1519 bp, Glycine max
cttttctccttctctctcgcacacgcaaacacttgttccggtgtccctctctctttcgcttcatcttcaacattaggtcttctctgactctgtggttgtcactgttcaacgtctttggatttattgccgggccttgaggtaatcagcttaccaacatgggaacacaaccccagcaaacatttcgggaggaagaggaggaggagatgcaaggccatggaactacgatgtcaggtcaatcaatgtcaacaagcagaagtgtcgggtctccatccagccggagtgagcagacaatggcaacacctgctagtgatagcacttttcttaggttaaaccatcttgacatacatggtgatgatgctggatcacagggcaccgttgccaagaagaaaaagaggggccaacgggctgttggaggtgataagagtggaagaggtctccgtcaattcagtatgaaagtgtgtgagaaggtagaaagcaagggcagaacaacttacaatgaggtagctgatgaacttgtggccgaatttgctgatccaatcaatggtgtttcaactcctgatcagcaacaatatgatgagaaaaacattcgtcgaagggtgtatgatgctttgaatgttctcatggcaatggatattatttctaaggataaaaaggaaattcaatggaagggtctccctcgtactagtctaagcgatattgaagagctaaagtcggagcgtcttgggctaaggaatagaattgaaaagaaagcagcctatttgcaagagctggaggagcaatacataggtcttcagaaacttatacaacgaaatgagcaactatatagctcaggaaatgctcccaatggaggtgtatctttgcccttcattctggtgcagacacggccccatgcaactgttgaagtggaaatatcagaagatatgcagcttgtgcattttgatttcaatagcactccctttgagctgcatgatgataactatgttctcaaggcaatgaaattttgtgagagatctcagaatgataatacaacagataattctacagatggcggtgaaggttctagcatatatgcacaggttcctacttcagtttcaaaccctccaaataggcctccttcatctccaccactccctggaatattaaaggcaagagttaagaacgagcattgatatgcaattttgtactgcatcgccttatttaagcatgtttgtatatttttgtaaagtaatttgtcagtaattaattgtccttcataatagttaatcagtacagccaattcactcagtaggttagaagcgaaccagtgtgcttgagtctatattcttctgggttgattttggcaaattctttgctaaccatatccattatttactaccttaagaccttaactgatttttttccccacattttctgtgtatttgcccttttgtacttataatagagaaattggtttgcaccagtccatagagatcatggaatgttatacatcagcgtaggattaattttggaattctcagat

SEQ ID NO: 4409 - DNA, 3887 bp, Arabidopsis thaliana
atggcgacagtgagtggaaggagacgcaaaaggaagatacaattaagcaagcttttcacattaacaggtgctaaagcttgtttcaagcctgaccattcgaaaattggacgatctggtttctctcgtgtggttttctgcaaccaacctgattcccctgaagctgaatcaaggaattactgtgacaattatgtgaggaccactaagtataccctcgccactttcctccctaaatcattgtttgagcagttcaggagagttgccaatttctacttccttgttgttgggatcttgtcttttactcctctggcgccatataccgctgtgagcgccattgttccgctgacgttcgtcattctcgctactatgtttaaagagggtgtagaagattggcgccggaaacagcaggatattgaagtgaataacagaaaagttagagtgcaccgaggcaatgggaattttgatcttagggaatggaagacactaagagttggggatatattgaaggtagagaaaaacgagttttttccggcagaccttgtcctgctttcttctagctacgaggatgctgtttgctatgtagagacaatgaaccttgacggggaaacaaatctgaaacttaaacaaggactagaagtaacattgtcattgcgtgaagagctcaatttcagggattttgaggcttttatcaaatgtgaggacccgaatgctaacttatactcgtttgttggtactatggaccttaagggagaaaagtaccctctctcaccacagcagcttcttctgaggggctcaaaactcaggaacacagactacatctatggggttgttatcttcacaggacctgatacaaaagttgtccagaattcaacagatcccccttctaagagaagcatgatcgagaggaagatggataagattatatacctgatgttccttatggtattttcattagcattttttggttcagttttatttggaatatggacgagagatgatttccagaatggcgtgatggaaagatggtatctgaaaccggatgattccagcatcttctttgacccaaagagggcgccaatggctgcaatatatcactttctaacggcgctaatgttaaatagttatttcattcctatatccttgtatgtgtcgatagagatcgttaaagttcttcagagtatcttcatcaatcaggatatccatatgtattatgaggaagctgacaaaccggcacatgcacgtacttccaatctgaatgaagaacttgggcaagtgggtacgatactttcagataagacaggaacattgacttgtaactccatggagttcattaagtgttctattgctgggacagcctatggacgtggtgttacagaggtggagatggctatggataagagaaaaggttctgctttggtgaatcagagcaatggaaatagtaccgaggatgctgttgctgcagaaccggctgtgaaaggattcaactttagagatgaaaggataatggatggaaactgggtcacggaaacgcatgctgatgtcattcagaaattctttcaattactggcagtatgtcatacagtcatacctgaagtggatgaagatacaggaaagatctcctacgaggctgaatcaccggatgaggcagcatttgttattgcagcaagggagcttgggtttgaatttttcactcgaactcaaacaacaatatccgtcagagagctagacctggtgactggggaaagagttgaaaggttgtatagtgtcctgaacgttcttgaattcagtagctcaaagaagaggatgtcagtaatagtgcaggatcaagatggcaaactacttttactttgtaaaggggcagacagtgtcatgtttgaaagactttccgaaagtggtagaaagtatgaaaaggaaacccgggaccatgtgaacgagtatgctgatgctggattgagaactttgatacttgcctatcgtgaactcgacgagaatgaatacgaggtattcactgagagaatcagtgaagcaaagaattcagttagtgctgatcgagaagcactgatagatgaagtaacagagaagattgagaaaaacttggttcttcttggagctactgctgttgaggataaacttcaaaatggggttcctgattgcattaataagcttgctcaagcaggaataaagatttgggttttgactggagacaagatggagactgccatcaatattggcttcgcttgtagtttgctcagacgagacatgaagcagataataattaacttggagactcctgaaatccagcagttggaaaaatccggagagaaagatgccattgcaggctttaaaggaaaatgtactgcatcagataactagtggaaaggctcaactgaaagcgtctggtggaaacgctaaggcttttgctttaatcattgatgggaaatcacttgcttatgcattggaggaagatatgaaaggcatcttccttgagctggccattggttgtgcttcagtgatttgctgccgttcatcaccaaaacagaaggcactggtaacaagactagtcaaaactggaagtggtcagacgacactggcaattggcgatggcgcaaatgatgttggaatgcttcaggaagcagatataggagttgggatcagtggcgtggaaggaatgcaggctgtaatgtctagcgatattgccattgctcaattcagatacctggagcgtttgttactggtccatgggcactggtgttacagacggatctcaaaaatgatttgttatttcttctacaagaacatcacatttggtttcactctgttcttatatgaggcatacacatcattttcagcgacaccggcttacaatgactggtatctatctctatatagtgtctttttcacgtctcttcctgtaatttgtttgggcatcttcgaccaggatgtatctgcaccgttttgtctcaagttccccgtattgtaccaagaaggtgtacagaatctcctatttagttggcgccggatactaagctggatgttccatggcttctgcagcgcaataatcattttctttctgtgcaaaacctctcttgaatctcaagctttcaaccacgaagggaaaaccgcagggagagatattctagggggaacgatgtacacatgtgtggtgtgggttgtgagtttgcagatggtcttgacgatcagttacttcacattgatccaacatgttgtcgtttggggatccgttgttatatggtaccttttcctgatggtgtacggatcccttccaataagaatgtctacagatgcctatatggtcttccttgaagctcttgcacctgcgccttcgtactggatcaccactctctttgtagtgctatcgacaatgatgccttacttcatcttctctgctattcagatgaggtttttcccaatgtcacatggaaccgtacagctgcttagatacgaggatcagtgcagcaactctgggaactttgaaatggggaggcagggatcagtgaggcctacactggtcatgagatctcatcagccagaatcttgataactgatgaacgaataccgatatttatctcgtcagatgatttgggctttagttactttgcaggatgtaaataagctaatcaaactttagactggaggagatccggtacaagactggaagaacagaggctctttaactggtttgtatagcataaaaaagaaaacaagagtttatagagagttctgattattgcggccttgaccagtaaaaataaaacaagagtttatagagtttgtatgttaagaaacatctaattatattagaaaatagaggaagactatacatcagtttagatcagagcagataaaagatatacagtaactttgtcttc

SEQ ID NO: 4410 - DNA, 1701 bp, Brassica napus
ggtgacaaatctccatctagttgtgtcttttttatttccttctccttccttccttccttccttccttccttcagttcaaagtgtcaacttcagttcctccatacttcttctccatctccatctctctgtcgctctcctaaattcccatctctcccgtgcagatttaattcttttattttccatttattacagaaaccaaaacgatttatagtttttgttcctctgggttttctctttattcttctgtgtcatcatcctctctacttattgagaatctaaaaaaagcatctttgttctctctaatccgatcgtacagtttcatattccaattccattttttactcaacctgtcatgtttaaccaatcaaaaagaacacaactctggtaactatctccatctatctagttagggtttttgtgtcagaaacatataatcagtgttctttgtctggagaaaaagaatgggatctgcaagtgggttttactcaaacgaagggtttgaattggatcctaaatggctggttgatcctcgtcatctctttgttggtcccaagatcggcgaaggtgctcatgccaaagtttatgagggaaagtatagaaaccaaacagtggctattaagattatcaaaagaggagagtcccctgaagagattgctaaaagagacagccggttcgctagagagatcgctatgttgtccaaagtccagcacaagaacttagtcaagttcattggagcgtgcaaagaacctatgatggttatagtcaccgagcttctactaggcggtacattgcgtaaatatctagtcagcttgcggcctaaacgtttagatatacgtttggctgtagcgtttgctcttgacattgctcgtgccatggaatgtttgcattctcatggaatcattcaccgcgatctcaaaccagagaatttgatcttatctgcggatcataaaaccgtaaaactcgctgatttcggtttagcgagagaagaatcattaaccgaaatgatgaccgcagagactggtacataccgttggatggccccagagctatacagtacggttacattaagacatggagagaagaaacactataaccataaagtagatgcttacagcttcgccatcgtcttgtgggaactcatcctcaacaagttaccatttgaaggcatgtctaatctacaagcagcctatgccgctgccttcaagaacttgaggcctagtgcagaggatttaccaggggaactagggctgatagtgacatcatgctggaaagaagatccaaacgaacggccaaacttcactgagataattcaaatgctcctccgttacctctccaccgtttcgcctccgcagatcgttcctcctccggtgagacgtgttttctcgtcggaaaacgtggttttctcaccggactctccgggaacttgttcactgatgaatgtgagagagaaagatggctcaggtcagaacgttaacgctgctgattcgtcggagaaggaaacaaaaggaagcttcttcttctgctgctcatagatgatggtgatggatactatataagatatcggttgtaattgtgtaaaggaaacggagaggtgaagtgtttgtttgttgtatggaaatgataaatagcaaagaacttagatcatcacagtaacgagaaaaaactttattgtacgtgccttcgtgtcctaattgaaaaata

SEQ ID NO: 4411 - DNA, 1639 bp, Brassica napus
  misc_feature (527)..(527): n is a, c, g, or t
  misc_feature (1217)..(1217): n is a, c, g, or t
  misc_feature (1280)..(1280): n is a, c, g, or t
  misc_feature (1349)..(1349): n is a, c, g, or t
  misc_feature (1355)..(1355): n is a, c, g, or t
  misc_feature (1367)..(1367): n is a, c, g, or t
  misc_feature (1376)..(1376): n is a, c, g, or t
  misc_feature (1379)..(1379): n is a, c, g, or t
  misc_feature (1385)..(1385): n is a, c, g, or t
  misc_feature (1394)..(1394): n is a, c, g, or t
  misc_feature (1406)..(1406): n is a, c, g, or t
  misc_feature (1433)..(1433): n is a, c, g, or t
  misc_feature (1482)..(1482): n is a, c, g, or t
  misc_feature (1486)..(1486): n is a, c, g, or t
  misc_feature (1491)..(1491): n is a, c, g, or t
  misc_feature (1493)..(1493): n is a, c, g, or t
  misc_feature (1495)..(1495): n is a, c, g, or t
  misc_feature (1502)..(1502): n is a, c, g, or t
tccttcagttcaaagtgtcaacttcagttcctccatacttcttctccatctccatctctctgtcgctctcctaaattcccatctctcccgtgcagatttaattcttttattttccatttattacacaaaccaaaacgatttatagtttttgttcctctgggttttctctttattcttctgtgtcatcatcctctctatacttattgagaatctaaaaaaagcatctttgttctctctaatccgattgtacagtttcatattccaattccagttttttactcaacctgtcatgtttaaccaatcaaaaagactccaactctggtaactatctccatctatctagttagggtttttgtgtctgaaacatataatcagtgttctttgtctggagaaaaagaatgggatctgcaagtgggttttactcaaacgaagggtttgaattggatcctaaatggctggttgatcctcgtcatctctttgttggtcccaagatcggcgaaggtgctcatgccaaagtttatgagggnaagtatagaaaccaaacagtggctattaagattatcaaaagaggagagtcccctgaagagattgctaaaagagacagccggttcgctagagagatcgctatgttgtccaaagtccagcacaagaacttagtcaagttcattggagcgtgcaaagaacctatgatggttatagtcaccgagcttctactaggcggtacattgcgtaaatatctagtcagcttgcggcctaaacgtttagatatacgtttggctgtagcgtttgctcttgacattgctcgtgccatggaatgtttgcattctcatggaatcattcaccgcgatctcaaaccagagaatttgatcttatctgcggatcataagaccgtaaaactcgctgatttcggtttagctagagaagaatcattaaccgaaatgatgaccgcagagactggtacataccgttggatggccccagagctatacagtacggttacattaagacatggagagaagaaacactataaccataaagtagatgcttacagcttcgccatcgtcttgtgggaactcatcctcaacaagttaccatttgaaggcatgtctaatctacaagcagcctatgccgctgccttcaagaacttgaggcctagtgcagaggatttaccaggggaactagggctgatagtgacatcatgctggaaagaagatccnaacgaacggccaaacttcactgagataattcaaatgctcctccgttacctctccaccgtttcncctccgcagatcgttcctcctccggtgagacgtgttttctcgtcggaaaacgtggttttctcaccggantctccnggaacttgttcnctgatgaangtnagaganaaagatggntcaggtcagaangttaacgctgctgattcgtcggagaangaaacaaaaggaagcttcttcttctgctgctcatagatgatggtgatgnatantattntnanatatcgnttgtaattgtgtaaaggaaacggagaggtgaagtgtttgtttgttgtatggaaatgataaatagcaaagaacttagatcatcacagtaacgagaaaaaactttattgtacgtgccttcgtgtcctaattgaaaaata

SEQ ID NO: 4412 - DNA, 1623 bp, Arabidopsis lyrata
acgcggaaaaagcaaacaactttcgatttctttaatctcttttttattttcttgtttctcaaaagccaaaaaaacccctaaaataagaaacttttttagaaaaaaaaatctttaaccaaaccaacacgaatcatcaagttttgaccatttctccatcagttccagtgtcaacttcagttcttcccattcttctttcaaattcccaacttttccgtgcagttttttttgttttctttttatagttgacgaattaggattttgattttgattgtcgtcttcttctttctttattctgtgttctggggaatccttgatttctctctttatattccaccaaaaaagcatctttgtttctttatctatctgattgttgtatagttctcaattccaataccaaacagaatgattaatcaatcaaaaagggcccagctttgacatatctctctctctagctaactagggttttgtttttttgttctgggtttgtggaaaaatgggatctgcaagtgggttttactcaaacgaagattttgaattggatcctaaatggcttgttgatcctcgtcatctctttgttggtcctaagatcggtgaaggtgctcatgccaaagtttatgagggaaagtatagaaaccaaacagttgcgattaagattattaaaagaggagagtcccctgaagagattgctaaacgagataaccggtttgcgagagagattgctatgttgtctaaagtccagcacaagaatttggtcaagttcattggagcgtgcaaagaacccatgatggttatagttaccgagcttctactaggtggcacattgcgaaaatatctagtgagcttacggccaaagcgtttagacattcgtttggctgttggatttgctcttgacattgctcgtgcaatggaatgtttacattcccatggaatcattcaccgcgatcttaaaccagagaatttgatcttatcagcagatcataagacagtgaaacttgctgatttcggtttagctagagaagaatcattaaccgagatgatgaccgcagagactggtacataccgatggatggccccagagctttatagtacggttacgttaaggcaaggagagaagaaacactataaccataaagtagatgcttacagcttcgccattgtcttgtgggaacttatactcaacaagttaccatttgaaggcatgtcgaatctacaagcagcctatgctgctgcattcaagaacttgaggccgagtgcagaagatttaccaggagacttagagatgattgtcacttcatgctggaaagaagatcctaacgaacggccaaatttcacagagataatccaaatgctcctccgttacctcacaactgtttcatcagcaccacagatcattcctccaccgaatcgacgagttttctcttcagaaaacatagttttatcaccggaatctcccggaacatgctctctgatgtctgtcagagacggagatgtttctcgtcagaccgttaacacggcagattcatcagagaaacaaacaaaaggaagcttcttctcctgctgctcatagatgaaaaatttataatatatttggttgtaatctgtaaaaataacgagaggaaagta

SEQ ID NO: 4413 - DNA, 1734 bp, Arabidopsis thaliana
acgcggaaaaagcaaacaactttcgatttctttactcctttttttccttctctctcaaaacccctaaaataagaaacttcaaaaaaaataatcattaaccaaaccaacacgaatcatcaaaattttgaccatttctccatcagttccagtgtcaacttcagttcttcttcccattcttctctcaaattcccatctttgccgttcaatgtttttgttttctttatgtagttgacgaaattaggattttgattgtcgtgtttctttctttattctgtgttcggggaatcctttgataattttctctctttatattccaccaaaaaaaaaagcatcttttttgtttctttatctatctgattgttgtatagtttctcaattccaaaaccaaacagaatgattaatcaatcaaaaagggcccagctttgacatatctctctctttctctctttagccaactagggtttttgtgatttttgttctggggttgttgtgggaaaatgggatctgcaagtgggttttactcgaacgaagagtttgaattggatcctaaatggcttgttgatcctcgtcatctctttgttggtcctaagatcggtgaaggtgctcatgccaaagtttatgagggaaagtatagaaaccaaacagtggcgattaagattattaaaagaggagagtcccctgaagagattgctaaacgagataaccggtttgcgagagagattgctatgttgtctaaagtccagcacaagaatttagtcaagttcattggagcgtgcaaagaacccatgatggttatagttactgagcttctactaggcggtacattgcgtaaatatctagtcagcttacggccaaagcgtttagacattcgtttggctgttggttttgctcttgacattgctcgtgcaatggaatgtttacattcccacggtatcattcaccgcgatcttaaaccagagaatttgatcttatcagcggatcataagacagtgaaactcgctgatttcggtttagctagagaagaatcattaaccgagatgatgaccgcagagactggtacataccgatggatggcccccgagctctacagtacggttacgttaaggcaaggagagaagaaacactataatcataaagtagatgcttacagctttgccattgtcttgtgggaacttattctcaacaagttaccatttgaaggcatgtcaaatctacaagcagcatatgctgctgcattcaagaacttgaggccaagtgcagaggatttaccaggagacttagagatgattgtaacttcatgctggaaagaagatcctaacgaacggccaaatttcacagagataattcaaatgctcctccgttacctcaccactgtttcggcaccacagatcattcctccaccgaatcgacgagtcttctcatcagaaaacatagttttatcaccggaatctcccggaacttgctctctgatgtctgtcagagacggagacgtttctcgtcagaccgttaacactgctgattcatcggagaaacaaacaaaaggaagcttcttctcctgctgctcatagatgatgtatttcgttgtgtaatctgtaaagaaaacgagaggaaagtgtttatgatggaaaaaagtataatgtattaagattagaaatttagatcacagtcacaagaaattgttcgtgtataaaaaatattgagcctgaaacattaataatgtttacgtttttgcat

SEQ ID NO: 4414 - DNA, 1179 bp, Brassica oleracea
  misc_feature (61)..(61): n is a, c, g, or t
ggggatctgcaagtgggttttactcaaacgaagggtttgaattggatcctaaatggctggntgatcctcgtcatctctttgttggtcccaagatcggcgaaggagctcatgccaaagtttatgaggggaagtatagaaaccaaacagtggcgattaagatcatcaaaagaggagagtcccctgaagagattgccaaaagagacagccggtttgctagagagattgccatgttgtctaaagtccagcacaagaacttagtcaagttcattggagcgtgcaaagaacctatgatggttatagtcactgagcttctactaggcggtacattgcgtaagtatctagtcagcttgcggccaaagcgtttggatatacgtttggctgtagcgtttgctcttgacattgctcgtgctatggaatgtttgcattcccatggaatcattcaccgcgatctcaaacctgagaatttgatcttatctgcggatcataaaaccgtaaaactcgctgatttcggtttagcgagagaagaatcattgaccgaaatgatgaccgcagagactggtacataccgttggatggcccctgagctttatagtacggttacactaagacatggagagaagaaacactataaccataaagtagatgcttacagctttgccatcgtcttgtgggaactcatcctcaacaagttaccatttgaaggcatgtctaatctacaagcagcctatgccgctgccttcaagaacttgaggcctagcgcagaggatttaccaggggaactagggctgatagtgacatcatgctggaaagaagatcctaacgaacggccaaacttcactgagataattcaaatgctcctccgttacctctccaccgtttcccctccgcagatcgttcctcctccggtgagacgtgttttctcgtcggaaaacgtggttttctctccggattctcctgggacttgttcactgatgaatgtgagagagaaagacggttcaggtcagaacgttaacgctgctgattcgtcggagaaggaaacaaaaggaagcttcttcttctgctgctcatagatgatggtgatgaatagtatttataagatatgggttgtaatgtgtaaaggaaacggagaggaagtgtttgttgtatggaatgatataaatagcaaagaacttagatcac

SEQ ID NO: 4415 - DNA, 1638 bp, Raphanus sativus
  misc_feature (561)..(561): n is a, c, g, or t
  misc_feature (653)..(656): n is a, c, g, or t
  misc_feature (658)..(659): n is a, c, g, or t
  misc_feature (661)..(663): n is a, c, g, or t
  misc_feature (926)..(926): n is a, c, g, or t
  misc_feature (1010)..(1010): n is a, c, g, or t
  misc_feature (1132)..(1132): n is a, c, g, or t
  misc_feature (1148)..(1148): n is a, c, g, or t
  misc_feature (1172)..(1172): n is a, c, g, or t
  misc_feature (1189)..(1189): n is a, c, g, or t
  misc_feature (1289)..(1289): n is a, c, g, or t
  misc_feature (1310)..(1310): n is a, c, g, or t
  misc_feature (1319)..(1319): n is a, c, g, or t
  misc_feature (1325)..(1325): n is a, c, g, or t
  misc_feature (1412)..(1412): n is a, c, g, or t
  misc_feature (1427)..(1427): n is a, c, g, or t
  misc_feature (1478)..(1478): n is a, c, g, or t
  misc_feature (1565)..(1565): n is a, c, g, or t
  misc_feature (1630)..(1630): n is a, c, g, or t
  misc_feature (1636)..(1636): n is a, c, g, or t
gggaccaaatctccatctagttgtgtcttttatttcttttcttctctccttccttcagttcaaagtgtcaacttcagttcctccatacttcttctccatctccatctctctgtcgctctcctaaattcccatcttctccgtgcagatttaatttttttttttttttccatttattacagaaaccaaaacgatttatagtttgtgttcttgcgaggtttgttctttattcttctgtgtcatcatcctctacttaattgagaatctaaaaaaagcatctttcctctttctttctaatccgattgtacagttttcatattccaattccagttttttcactcaaccctgtcatgtttaatcaatcaaaaagacttcaactttggtaactctctatctatagttagggtttttgtgttcagaaacatataatcttgtgtctggagagaaaagaaatgggatctgcaagtgggttttactcaaacgaaggtttttaattggatcctaaatggctcgttgatcctcgtcatctctttgttggtcccaagatcggcgaaggtgctcatnccaaagtttatgagggaaagtatagaaaccaaacagtggcgattaagataataaaaagaggagagtcccctgaagagattgccaaaagaggnnnncnntnnncaagagagatcgctatgttgtctaaagtccagcacaaaaacttggtcaagttcattggagcgtgcaaagaaccaatgatggttatagtcaccgagcttctactaggcggtacgttgcgtaaatatctagtcagcttgcggcctaaacgtttggatatacgtttggctgtagcgtttgcgcttgacattgctcgtgcgatggaatgtttgcattcccatggaatcattcaccgcgatctcaaaccagagaatttgatcttatcngaggatcataagacggtaaagctcgctgatttcggtttagctagagaagaatcattaacagaaatgatgaccgcagagactggnacataccgttggatggcccctgagctttacagtacggttacgttaagacatggagagaagaaacattataaccataaagtagatgcttacagcttcgccatcgtcttgtgggaactcattcncaacaagttacccttngaaggcatgtccaatctacaagcngcctatgctgctgcctncaagaacttgaggcctagtgcggaggatctaccaggggaactagggttgatagtgacgtcatgctggaaagaagatcctaacgagcggccaaacttcacngagataatacaaatgctcctncgttacctntccacngtttctcctccgcagatcgttcctcctcccgtgagacgtgttttctcgtcggagaacgtggttttctcaccggattctcctggtacntgttcgctgatgaangtgagagacaaagatggttcgggacagaacgttaacgctgctgatccgtcngagaaggaaacgaaagggagcttcttcttctgctgctcatagatgacgatgatgatggattactataaaaagataaatcgggttgtnattgtgtaaaggaaacgagagagaagttgtatttgttatatggaatgataaatagcaatgaactnttaganca

SEQ ID NO: 4416 - DNA, 1385 bp, Manihot esculenta
aaatgggatctaataatgctttttattctggtgaattcaatttggatgctaagtggctgattgatcctaagcttctttttgttggacccaagattggagaaggcgctcatgccaaagtttatgagggaaagtataagaatcaaaatgttgctattaaagttgttcatagaggagaaaccccagaagagattgccaagagagaagcaagatttgcgagagaggttgcaatgttatctagagttcaacacaaaaatctagtgaagtttattggagcttgcaaggaacctgtaatggtgatagtaacagaactccttttaggcgggacattgcgtaaatacctgttgaacatgcgaccaagatgcttggagatgcatgttgcaattgggtttgcacttgatattgctcgtgcaatggaatgcatacactcgcatggaatcattcatcgtgaccttaaacctgagaacttgatcttgactgccgaccataaaacagtgaaacttgcagattttggtttagccagagaagagtcattaacagagatgatgactgctgaaactgggacgtatcgttggatggctccagagctttatagcactgtcacattaaggcacggcgagaaaaagcattacaatcacaaggtggacgcttatagctttgcgattgtcttgtgggagctcatccacaataaattgccatttgaaggcatgtcaaatttacaggcagcatatgcagcagcttttaagaatgtgagacccagcgcggagaatctcccagaggatctagcaatgattgtgacctcatgttggcaagaggatccaaacgctcgacccaatttcagccagatcatacagatgcttctgcgctatctttccaccgtttcaccaccagaacctgtcatccccgctcgaatattcacttcagagaatgctgtgctgccaccagagtctcctggcacaagttctttaatggctgtcagagatgactcaggagaaaccccaaaagcacagatggaggacaaaccaagaggtttctttttctgctttaaccagtgttactgatctctccaaaggcacaaagtcgtcagtggaggtattttaggcaacctcaataaacaatagttctcaaaaaatattaggaaatagatcttgataagaaaaacagcaacctagttagttcagttgcaatgcaacaggtatgctacctagtatctgatgtctccattaacttttcatactcttacatgaatatcagtttgttctgacaagttcacctggagactggagttaggatttgctgtaatgcatcagcattattgtaaaataaggtccatccaaaggccttactcctgttgataatgtttaatcaaaacgagttttgttagaatc

SEQ ID NO: 4417 - DNA, 1939 bp, Solanum lycopersicum
tcaccttcctcttttttctttgcagatcaagaaaccagagcaacttataaataaaaagtattagcaccaactaaagtctcctaattgcttaacattcatctctatctttcattatctttcctcttattctactcactcttcaccttatttatctctcttttttcttctcctcctcctgatagcctcaattgatccaccaaccaaaccagctgatctacttcttctgaactttttatttttcaattgaaccagtaggaatttctggggtttcttgtttgtggggttcatttttctcttgttttaaacacaagggcatgttgtagatttgtttctggtttgtgggtctatgagttttctggttcttggtcataaagtcttgaactttttttgctgcttcaaatgctaggtgaattgttattaagtgtttcgaatttggtagttaaatagatgtgctactagttcattcttgaagttattatagggggagagtatttggggtctggaaaatgggatctgctaatgggttttactccggagaagaagagttcaatttggaggcgaaatggttaattgatccgaagcttctgttcgttggtcctaagattggagagggtgctcatgccaaagtgtatgagggaaaatacagaaaccagaatgtagcaataaagattgtgcataaaggggagacacctgaggagattgccaagagggaatctcgttttggaagggaggttgctatgttatccagagttcagcacaagaacttagtgaagttcataggagcttgcaaggagcctgtcatggtcatagtaactgaacttcttctcggggggacgctgaggaaatacttgctgaacctgaggccaaggtgcttggatactggtgtcgctattagatttgcccttgatatagcccgtgcaatggagtgcttgcactctcatggtatcattcatcgcgacctaaaacctgagaacttgcttttgactgcggaccacaaaactgtcaaacttgcggattttggtttggcaagagaagaatcattgacagagatgatgactgctgaaactggaacctatcgctggatggctccagagctctacagcacggtcactttaagacacggcgagaagaagcattataatcataaagtagatgcctacagttttgcgatcgttctgtgggaactcgtacataacaaattaccatttgagggcatgtctaatttacaggctgcttatgcagctgcttttaagaatgtgagaccaagtgcagatgatctccccgaggatttggcagtaattgtaacttcgtgttggaaagaggatccaaacactcgtcccaacttcactcagataatacagatgcttcttcattttctctcttcagtttcccctccggaaccagtaataccagctaggattttcacttcagagaatcatgtattaccaccggagtctccaggtaccagctcgttaatgtccaagcgtgatgactcggttgagacccctaaaacacccatggagaatcagccaagaggtttcttcttctgttttaaccaatgctactgatccccaagggaaaagtttgttaattctctagaaaatactcggagttgagctatcttattatacaatagtaagctcacaaaatgtttagcccagatatgtcactagataacttagcttttggtctttcttccacataagataaaaaggtacacttttgagttttagccatggtaattcaaaggtgaaggacgttgttgcaggaagatgcatgatctagactcgcgttctgacttaattgtgaggagttgggttgctgtgatgtatattatagttgtaaaaaataaggtccatccaaagacctgtactcctatattttgttaaacctcaattgactctcgtcgtttatatgaactgattaatgtagctattct

SEQ ID NO: 4418 - DNA, 1969 bp, Raphanus sativus
  misc_feature (897)..(897): n is a, c, g, or t
ggcactccaattttgttatcggctaattccacaaccctcctctcctcctcctctcttctccggaaatacacgcgcagattcctcgaagcagtttggttaaaagtaaaatggttgtggttgggaatgtttctgcagcgaatttgccttatcaaaatgggtttttgaaggcaatttcatctggtggttgtgatttaatgggacaccgcagcttcagaatttcaacttgttcacaagctcttaagacaagaacaaggaggagtgctggtcctttgcaggtagtttgtgtggatataccaaggccagagctagagaacactgtcaacttcttagaagctgcaagtttgtctgcatctttccgtagtgctcctcgtcctgcgaagcctttaaaagttgtgatcgctggtgctgggttggctggattgtcaacagcaaagtacctggctgatgcaggacatatacctctgttgctcgaagcaagagatgttcttggtggaaagatagctgcatggaaggatgaagatggagattggtatgaaaccggtttacatatatttttcggtgcatatccgaatgtgcagaacttatttggagaacttgggatcaatgatcggttgcaatggaaggaacactccatgattttcgccatgccaagtaaacctggggaatttagtagatttgatttcccagatgttctaccagcacccttaaacggtatatgggctattttgaggaacaacgagatgctgacatggccagagaaaataaagtttgctattggacttcttccagccatggtcggaggtcaagcttatgttgaggcccaagatggtttatcagtagaagaatggatgagaaagcagggagtacctgatcgcgtgactgatgaagtgtttatanccatgtcaaaggcacttaacttcataaaccccgacgaactgtcaatgcaatgcattttgatagctttgaaccggtttcttcaggagaaacatggttccaagatggccttcttagatggtaatcctccagagaggctatgcatgccgattgttgaacatattcgatcactaggtggtgaagtacgacttaattcaaggataaggaagattgagctggaggatgatggcacggttaagaatttcttactcactgatggaacaactatccaaggagacgcttatgtgttcgccactccagttgatatcctgaagctccttttgcctgattcatggaaagaaataccatacttcaagagattggagaagttagttggtgtgccagtcattaacgttcatatatggttcgatcggaaactgaagaacacatatgatcacttactctttagcagaagtaaccttctgagtgtgtatgcagacatgtcgttaacttgcaaggaatattacgatccaaaccgatcaatgctggagctagtatttgcacctgcagaggaatggatatcacggaccgactctgacatcatagatgcaacaatgaaagagctcgagaaactcttccctgacgaaatcgcagctgaccaaagcaaagctaaaattctcaagtaccatgtcgtcaaaactccaaggtctgtgtacaagaccatcccagactgtgaaccatgtcgtcctctacagagatctcctattcaaggcttttacttagctggagactacactaaacagaagtacttagcttccatggaaggcgccgttctttctggcaaattctgctctcagtctattgtgcaggattatgagctattggctgcgtctggacgtcgaaacttgtcggagacaactgtatcaacatgagaagaggaagcttaaagatcattgatttgtgcttgtaaccattattttgtaacttttgtgtacaaaccacatttgaatacaaagctaatggtgtggcagaaaaccaatacataatgtaaaaaaaatataggagttatttaaggaaaaaaacatgaagagtaacg

SEQ ID NO: 4419 - DNA, 2131 bp, Arabidopsis thaliana
aaattacgttgagatgcatggtctctctctactcaattaaccaaataaggaaaagaatcatatggtcatcaattcgtaaatcaaaattttaatttgtgtggtatttaatccatctacatgtttcgtaagcaacaaaagagcttggtctgaaaaccaaacaagaccatatgggcactcgaatactccattttgttatcggctacttccactagcctcctccttcgctgcgtctcctgtttctctacttcacgattactcgctagattcattgaagcagttgtgagttaagttggagaaaatggttgtgtttgggaatgtttctgcggcgaatttgccttatcaaaacgggtttttggaggcactttcatctggaggttgtgaactaatgggacatagctttagggttcccacttctcaagcgcttaagacaagaacaaggaggaggagtactgctggtcctttgcaggtagtttgtgtggatattccaaggccagagctagagaacactgtcaatttcttggaagctgctagtttatctgcatccttccgtagtgctcctcgtcctgctaagcctttgaaagttgtaattgctggtgctggattggctggattgtcaactgcaaagtacctggctgatgcaggccacaaacctctgttgcttgaagcaagagatgttcttggtggaaagatagctgcatggaaggatgaagatggggactggtatgagactggtttacatattttcttcggtgcttatccgaatgtgcagaatttatttggagaacttgggatcaatgatcggttgcagtggaaggaacactccatgatttttgctatgccaagtaaacctggagaatttagtagatttgacttcccagatgtcctaccagcacccttaaatggtatttgggctattttgcggaacaacgagatgctgacatggccagagaaaataaagtttgctattggacttttgccagccatggtcggcggtcaggcttatgttgaggcccaagatggtttatcagtcaaagaatggatggaaaagcagggagtacctgagcgcgtgaccgacgaggtgtttattgccatgtcaaaggcgctaaactttataaaccctgatgaactgtcaatgcaatgcattttgatagctttgaaccggtttcttcaggaaaaacatggttccaagatggcattcttggatggtaatcctccggaaaggctttgtatgccagtagtggatcatattcgatcactaggtggggaagtgcaacttaattctaggataaagaaaattgagctcaatgacgatggcacggttaagagtttcttactcactaatggaagcactgtcgaaggagacgcttatgtgtttgccgctccagtcgatatcctgaagctccttttaccagatccctggaaagaaataccgtacttcaagaaattggataaattagttggagtaccagttattaatgttcatatatggtttgatcgaaaactgaagaacacatatgatcacctactctttagcagaagtaaccttctgagcgtgtatgccgacatgtccttaacttgtaaggaatattacgatcctaaccggtcaatgctggagctagtatttgcaccagcagaggaatggatatcacggactgattctgacatcatagatgcaacaatgaaagaacttgagaaactcttccctgatgaaatctcagctgaccaaagcaaagctaaaattctgaagtaccatgtcgttaagactccaagatctgtgtacaagaccatcccaaactgtgaaccatgtcgtcctctacaaagatcacctattgaaggattctacttagctggagattacacaaaacagaagtacttagcttccatggaaggcgctgtcctctctggcaaattctgctctcagtctattgttcaggattacgagctactggctgcgtctggaccaagaaagttgtcggaggcaacagtatcatcatcatgagaagaggacaaaacttaaagatgatttgcttgtaagcattattatttgtgtataaatctcattgcaatccaaacttaaccttactctcttcagtaaatgaatctcacagatttgacatctcacgtttctgtc

SEQ ID NO: 4420 - DNA, 2174 bp, Arabidopsis lyrata
tctctactcgattaaccaataaggaatagaatcatatggtcattaattcttatatcaaaattttaatttatgtgataattaatctatctacacatatttcgtaagcaacaaaagagcttggtctgaaaaccaaccaagaccatatgatgggcactcaaagcctccattttgttatcggctacttccactagcttccttcttcatctgcgtctcctcctggttctctactttacgattgctcactagattcattgaagcagttgtgacttaaggtggagaaatggttgtgtttgggaatgtttctgcggcgaatttgccttatcaaaacgggtttttggaggcactttcttcatctggaggtattgaattgatgggacacagctttagggttccgacttttcaagcacctaagacaagaacaaggaggagaagtactgctggtcctttgcaggtagtttgtgtggatattccaaggccagagctagagaacactgtcaatttcttggaagctgctagtttatctgcatctttccgtagtgctcctcgtcctgcaaagcctttaaaagttgtaattgctggtgctggattggctggattgtcaactgcaaagtacctggctgatgccggccacaaacctctgttgcttgaagcaagagatgttcttggtggaaagatagctgcatggaaggatgaagatggggactggtatgaaactggtttacatatattcttcggtgcttatccaaatgtgcagaacttatttggagaacttgggatcaatgatcggttgcagtggaaggaacactccatgattttcgctatgccaagtaaacctggagagtttagtagatttgacttcccagatgtcctaccagcacccttaaacggtatttgggctattttgcggaacaacgagatgctgacatggccagagaaaataaagtttgctattggacttttgccagccatggtcggcggccaggcttatgttgaagcccaagatggcttatcagtcaaagaatggatggaaaagcaggcaatacctgagcgtgtgactgacgaggtgtttattgccatgtcaaaggcactaaactttatcaaccctgatgaactgtcaatgcaatgcattttgatagctttgaaccggtttcttcaggaaaaacatggttccaagatggcattcttggatggtaatcctccggaaaggctttgtatgccaatagtggatcatattcgatcactaggtggggaagtgcaacttaattctaggataaagaaaattgagctcaataacgatggcacggttaagagtttcttactaactaatggaagcactgtcgaaggagacgcttatgtgtttgccgctccagtcgatatcctgaagctccttttaccagatccctggaaagaaataccgtacttcaagaaattggataaattagttggagtgccagttattaatgttcatatatggtttgatcgaaaactgaagaacacatatgatcacctactctttagcagaagtaaccttcttagcgtgtatgcggacatgtccttaacttgtaaggaatattacgatcctaaccggtcgatgctggagctagtatttgcaccagcagaggagtggatatcacggactgactctgacatcatagatgcaacaatgaaagaactcgagaaactcttccctgatgaaatctcagctgaccaaagcaaagctaaaatcctgaagtaccatgtcgttaaaacaccaaggtctgtgtataagaccatcccaaactgtgaaccatgtcgtcctctacagagatcacctattgaaggattctacttagctggagattacacaaaacagaagtacttagcttccatggaaggcgcggttctctctggcaaattctgctcacagtctattgtgcaggattacgagctactggctgcatctggatcgagaaagttatcggaggcaacagtatcatcatcatcatcatgagagaggacaaagcttaaagatgatttcttgtaagcactattatttgtgtataaatctcactgcaatccaaaattgaccctactctcttcagtaaatgaatctcacagatttgacatctctttaaaagagtaattactgtcgagcttttgtaatcatagtgatttatcattatgtctctctcttt

SEQ ID NO: 4421 - DNA, 2403 bp, Quercus alba
attaaggggggttagtacctaaaccctaaattgaaaatgaaaacagccaaaccgatacaaaagtagtgcaaattccacttacgtatgtcctaacgcactctcactcatcagttatcactatttataaccacaaactaaactaactactctctctctctctcctctggaattgaattggactactagacactagtactatcccttttgctcaagggtcttcacagttgaagttggaaactatttgtttgttgaattttgtgttaaatacattattaaaaaaaaaaacccttaatttggaaattgggtttggtgaaatgaccattggtgggtttgtttcggctgcaaacttgagctgccaaagtactttgacaggaaatcaaactctaagatgtgggtttcttaataattcagtgaaaaccaatgcattagcatttggaggttgtgaatccatgggtcatagtttgagaattccacatacaaaggctattagattgaggccgaggaagggtgtctctcctttgcaggtagtatgtatggactttccaagaccagagcttgagaatactgttaatttcttagaggctgcttatttgtcttcttcctttcgtgcatctgctcgtccatctaaacccctaacagttgtaattgctggtgcaggtttggctggtttgtctactgcaaagtatttggcagatgctggtcacaaacctatactattggagtcaagagatgtactaggaggaaaggtggctgcatggaaagatgacgatggagactggtatgagactggattacatatattctttggggcttacccaaatgtgcagaatctgttcggagaacttggtattgatgatcggttgcaatggaaggaacattctatgatttttgcaatgccaaataagccgggagagttcagccgatttgattttcctgaagttcttcctgcaccattaaatggaatatgggctatcttgaagaacaatgagatgctgacttggccagataaagtcaagtttgcgattggactcttgccggcaatgcttggtggacaggcttatgttgaagctcaagatggtttaactgttaaagagtggatgagaaagcagggagtacctgatcgtgtaactgatgaggtatttgtagccatgtcaaaggcgctaaacttcattaaccccgatgaactttcaatgcaatgcatattgattgctttgaataggtttcttcaggagaagaatggttccaagatggctttcttggatggtaatcccccagagagactctgtatgccaattgttgatcatattcaatcactaggtggtgaagtaagactaaattcgagaatacaaaaaatcgagctaaataatgatggaacagtgaaaagctttttactgaataatgggaacatgattgaaggagatgcttatgtatttgctactccagttgatatcctgaagcttcttttgccggaaaactggaaagagattccatatttccagagattaaagaaattagttggagttccagttattaatgtccacatatggtttgacagaaaactgaagaacacctatgatcacctactgtttagcagaagtccacttctcagtgtgtatgctgacatgtcagtaacatgtaaggaatattacaaccctaatcaatctatgctggagttggtttttgcgcctgcagaagaatggatttcacgcagtgactcagacattattgacgctacaatgaatgaacttgcaagactctttcccgatgaaatttccacggatcaaagcaaagcaaagattgtgaagtaccatgttgttaaaacaccaaggtctgtttacaaaactgtcccagactgtgaaccttgccgtcccttacaaagatctcctattgaggggttttacttagctggtgactacacaaaacaaaaatatttggcttcaatggaaggtgctgttctgtcaggaaagctttgtgctcaagctattgtacaggatcatgagttgcttatagctcgggggcaaacaaggttggctcaagcaagtgtttattgacaaaaatctttgcaaatggaggtaaatttttccttggttcaagaggatcatttaagtaatagttatggctcgtggatcaatgatatatcaacactaaagatatattttcagcccttggggtactatacatgatgatagcatattgagctgtctatttctgtagcttttctggatataggatcttctttttgttcctcatatgatgctcatcttgctgtaagtgtacataattttctccactgtctatctaaaagacaatgaaattaaggagagtaaataaattcgattcagtttgtgtacttaaactggtgtaccttatgtgcaatgtaatgcactgtatacgagtcaatat

SEQ ID NO: 4422 - DNA, 1937 bp, Ricinus communis
caagaatactctcctttcttgggttctttttattttgttattactttgatgttatcttgattttgtttacttaaaattttttcctgcaggttcttgcaattgtgtactattgtaaaagttaaagaaatggctctatatgggggtgtttctgctttgaatttaagctggcatagtgatgtcttagacactagaaatctgcaatcagcccttagatgtggttacgctacctgttctaatcaaaccaatgtactagcttttagaggcagtgaatctatgggccatgctttgagaaattcttctaaaacaagatttaggaatactggtagctgccctttgaaggtagtttgtgtggactatcctagaccagaccttgataacacagtgaatttcttggaagctgcctacttatcatcatcttttcgatcttcttcccctccagataaaccattgaaggttgtaattgctggtgcaggattggctggtttatcaactgcaaaatatttggcagatgcaggacacaagcctttattgctggaagcaagagatgttctaggtggaaaggtggctgcatggaaagatgatgatggggactggtacgagacaggcttgcatatattctttggagcatacccaaatgtgcagaacctgtttggagaacttggtataaatgatagattgcagtggaaggagcattctatgatatttgcgatgccaaacaagcctggagaattcagccgatttgatttcccagatgttcttcctgcaccattaaatgggatatgggcaattctgagaaacaatgagatgctgacatggccagagaaagtgaaatttgcaattggactcctgccagcgatggttggtggacaggcctatgttgaggctcaagatggtttaagtgttcaagagtggatgagaaagcagggcgtacctgatagagtgactaaggaggtttttattgctatgtcaaaggcgctaaactttattaaccctgatgagctttcaatgcaatgtatattgatagcattgaacagatttcttcaggagaaacatggttcaaagatggctttcttagatggaaatcccccagagagactctgcatgccaattgttgaccatgtgcagtcacttggtggtgaagtccggctaaattcacgaataaagaaaattgaattaaataatgatggagcagtgaagaactttttactaaataatggggaagtgattgaaggagatgtttatgtggttgctactccagttgatatcctgaagcttcttttgcctgataactggaaagagattccatacttcaagaagctggataaattagttggagttcctgttattaatgttcacatatggtttgacaggaagctgaagaatacatatgatcacctacttttcagcagaagtccccttcttagtgtttatgcggacatgtctgtaacatgtaaggaatattataatccaaatcagtctatgctggagttagtttttgcacctgcagaagaatgggtatcacgcagcgatgaagaaattattgaggctacaatgatggaactagcaaaactctttcctgatgaaatatctgcagatcagagcaaagcaaaaattgttaaataccatgttgtcaaaactcccaggtctgtttacaagactgtcccaaattgtgaaccttgccgacccttgcaaagatctcctatagagggcttctatttggctggtgactacacaaaacaaaaatatttggcttcgatggagggtgctgttctatccgggaagtattgtgcacaagccattgtacaggattatgggttgcttatcgctcgcaagcaaaaaaagttggctgagacttctggtatgcacattactgagctttactgcagaaggctgagttctgttgtctatggactttattgagcttacaatagatgatt

SEQ ID NO: 4423 - DNA, 1294 bp, Brassica napus
  misc_feature (1281)..(1281): n is a, c, g, or t
cggacgcgtgggaaagtcttaaaaagatacttaagaaatcaaatacttatcatctctctccaaaaagataacctcatagtgtcgacatggcttgccaaaacaatcttgttgtgaagcagatcatcgacttatacgaccaaatttcaaagctcgagtgtttgaaaccttcaaaaaatgtcgacactttgttcggacaactcgtgtccacgtgcttacccacggacataaacatcgatgtcacaaagatgagtgatgaagtcaaagacatgagatctaacctcatcaagctatgtggtgaagccgaaggctatttagagcaacacttctccacaatcttggggtccttaccaggagaccaaaacccacttgaccatttaaacatctttccttactataacaactacctcaagctaggcaagctcgagtttgatctcttgagtcaacactcgagccatgttcccaacaagattgccttcgttggctctggaccgatgcctctcacatccatcgtcttggctaagtttcatctcaagaacacgacgttccacaactttgacatcgactcacatgcaaacacactcgcttcaagcctcgtctctcgcgatccagacctctcaaaacgcatgatcttccacacaacggacgtgctaaacgctaccgaagggctagaccagtacgacgcagttttcttggcggctctcgttgggatggacaaagaggcaaaggtcaaagccatcgagcacttggagaagcacatggctcctggagctatcctcatgctgaggagtgctcatgctcttagagctttcttatatccaatcgttgactcttctgatctcaaaggtttccagctcttgaccatctatcatccgaccgatgatgttgttaactcggttgtgatcgcacgcaagctcggtggttcaagcatgaccggagtcaatggtactcgtggatgcatgttcatgccttgtaactgctctaaggtccatgcgattatgaacaatcgttgcaagaagttgatgatcgaggagtttagtgccatcgagtaatcaaagcaagtaattactgaacacatctcatctcttgagactatgtgttaatgttttgtcttatattaatttttctttttaatttcatgtgatcttgtgtgttttctgacgtgtgtggttcgtataagttggtgaattttgagttctttgatcttcgttatgaactgtgaagatacagaagaactctttcttcgttccttttttcatcaataaaaaataatataaataatgnttttatttgcttg

SEQ ID NO: 4424 - DNA, 1284 bp, Raphanus sativus
  misc_feature (95)..(95): n is a, c, g, or t
  misc_feature (113)..(113): n is a, c, g, or t
  misc_feature (116)..(116): n is a, c, g, or t
  misc_feature (125)..(125): n is a, c, g, or t
  misc_feature (256)..(256): n is a, c, g, or t
  misc_feature (272)..(272): n is a, c, g, or t
  misc_feature (303)..(303): n is a, c, g, or t
  misc_feature (356)..(356): n is a, c, g, or t
  misc_feature (370)..(370): n is a, c, g, or t
  misc_feature (416)..(416): n is a, c, g, or t
  misc_feature (739)..(739): n is a, c, g, or t
  misc_feature (966)..(966): n is a, c, g, or t
  misc_feature (1027)..(1027): n is a, c, g, or t
  misc_feature (1073)..(1073): n is a, c, g, or t
  misc_feature (1178)..(1178): n is a, c, g, or t
ggacagcacaaaattttcagtctttgaaagattgtttaagaaatccaatccttatcatctcttctaaaaataaccttatagtgtcgacatggctngccaaaacaatcttgttntgnagcagatcntcgacttatacgaccaaatttcaaagctcgagtgtttgaaaccttcaaaaaatgtcgacactttgttcggacaactcgtgtccacgtgcttacccacggacacaaacatcgatgtcacaaagatgagtgangaagtcaaagacatgngatctaacctcatcaagctatgtggtgaagncgaaggctatttagagcaacactctccacaatcttggggtctttaccagaagnccaaaacccacttnaccatttaaacatctttccttactacaacaactacctcaagctagncaagctcgagttcgatctcttgagtcaacactcgagccatgttccatccaagatgcctctcacatccatcgtcttggctaagttccacctacccaacacgacgttccataactttgacatcgactcacacgcaaacgcactcgcttcaagccttgtctctcgcgaccccgacctctcaaaacgcatgatcttccacacaacggacgtgctaaacgctacggaagggctagaccaatacgacgtagttttcttggcggctctcgttgggatggacaaagaggcaaaggtcaaagccatcgagcacttggagaaacacatggctnctggagctaccctcatgctaaggagtgctcatgctcttagagctttcttgtatccgatcgttgactcttctgatctcaaaggcttccagctcttgaccatctatcatcccaccgatgacgtggttaactcggttgtcatcgcacgcaagcttggtggttcgaccatgactggagtcaatggtactcgtggctgcatgttcatgccttgtaactgttctaaggtccangccattatgaacaaccgttgcaagaagatgatgatcgaggagtttagcgccatcgagtaancaaaagcaagtaattactgaacacatctcatatctcttgagactangtgttaatgtttttctcttatattaattgctattttcacttcatgtgatcttgtgtgttttttttttctgacgtgtgtggctagtataagctggtgaattttganttctttgatcttcgctatgaattgtgaagatacagaagaaccctttctctgttcccttttcatcatcaataaaaataatataagataatgtttttatttgtttggt

SEQ ID NO: 4425 - DNA, 1239 bp, Raphanus sativus
  misc_feature (42)..(42): n is a, c, g, or t
  misc_feature (103)..(103): n is a, c, g, or t
  misc_feature (224)..(224): n is a, c, g, or t
  misc_feature (655)..(655): n is a, c, g, or t
  misc_feature (707)..(707): n is a, c, g, or t
  misc_feature (901)..(901): n is a, c, g, or t
  misc_feature (1019)..(1019): n is a, c, g, or t
  misc_feature (1199)..(1199): n is a, c, g, or t
tttttctgagtcttgaaagcattactttactaaacctagctntatctctcttcatagtgtcgacatggcttgcgaaaacaacctcgttgtgaagcaaatcatngacttatatacccaaatctcaaacctcgagagtctaaaaccatccaagaatgtcgacactttgttcggacaacttgtctccacgtgcttgccaacggacacagacatcgatgtcacaaaantacacgatgaaaaagtcaaagacatgagatctcatctcatcaagctttgtggtgaagccgaaggatacttggagcaacacttctccacaatcataggctcgtttgaagacaacccacttaaccatttacacatctttccttattacaacaactacctcaaactaagcaaactcgaattcgatctcctagctcaacacacaagccatgtccctacaaaaatcgcttttatcggctccggtccgatgccacttacatccatcgtcttggccaagtttcaccttcccaacacaacgatccacaacttcgacatcgactcacaggctaacacactcgcttcaagcctcgtttctcgcgatccagacctctcggaacgcatgatcttccacacgactgatgtgttaaacgccaaggaagggttagaccagtacgangtcgttttcttggcggctcttgttgggatggataaagagtcaaaagtcaaanctattgagcatttggagaagcatatggctcctggagctgtgctgatgctaaggagtgctcatggtcttagagctttcttgtatccaatcgttgactcttgtgatcttaaagggtttgaagtgttgaccatttatcatccgtcagatgatgtggttaactcggtggtggtcgcacgtaagcttggtggttcgagngaagctggtagcagccagatcgaaaggtgtgtgattatgccttgtaattgctccaagatccacgccataatgaacagtcgaggtatgaagaagaatatgatcgaggagtttagtgccnttgaataaatacataacacaactctttctatagaggtatgtattatgtttttgctcttttaaattttgtgtttatctgtttatgatgtgggtgacatgtttgttaaacataataatttttgtgagttctttggtcgtcgtatcagtgtgaagtcacagaacccttgttgtttttactttnaattatttcgatcaataaaacatgaacttgaaaatcccca

SEQ ID NO: 4426 - DNA, 1173 bp, Arabidopsis lyrata
tttttcccaagtcttgaaaacaaattctaaactctatattctgtcctcatagtgtcgacatggcttgcgaaaacaacctcgttgtgaagcaaatcatcgacttatacaatcaaatctcaaacctcgagagcttaaaaccatccaagaatgtcgacactttgttcggacaactcgtatccacgtgcttacctacagacacaaacatcgatgtcacggagatacacgatgaaaaagtcaaagacgcgagatctcatctcatcaagctttgtggtgaagccgaaggttatttagagcaacacttttcaacaatcttaagctcttttgaagacaacccactaaaccatttacacatttttccctattacaacaactatatcaagctaggaaaactcgaattcgatctcctagcacaacacacaacccatgtcccgaccaaagtcgcttttatcggttcgggtccgatgccacttacatccatcgtcttggccaagttccatcttcccaacacaacgttccacaacttcgacatcgactcacacgccaacacactcgcttcaaacctcgtttctcacgattctgacctctcgaaacgcatgattttccacacaactgatgtgttaaacgctaaggaagggttagaccaatacgatgttattttcttggcagctcttgttgggatggataaagagtcaaaggtcaaagctattgagcatttggagaagcatatggctcctggagctgtgttgatgctaagaagtgctcatggtcttagagctttcttgtatccaatcgttgactcttgtgatcttaaagggtttgaggtgttaaccatttatcatccgtccgatgatgtggttaattcggtggtcatcgcacgtaagcttggtgggtcaaatggagctcgaggcagccagatcggacggtgtgtggttatgccatgtaactgctctaaggtccacgcgatcatgaacaatcgtggtatggagaagaatttgatcgaggagtttagtgccatcgagtaaacaaataacacatctcttttcttaagattatatgtgtttatgttttgctcttttcaattttatgcctatgtattgtgatgcgtgtggtttgtgtgttaagtataataagtttgtgaattttgtgagttctttgatcttcatctgtgtgaag

SEQ ID NO: 4427 - DNA, 963 bp, Arabidopsis thaliana
atggcttgcgaaaacaacctcgttgtgaagcaaatcatggacttatacaaccaaatctcaaacctcgagagcttaaaaccatccaagaatgtcgacactttgttcagacaacttgtgtccacgtgcttaccaacggacacgaacatcgatgtcacagagatacacgatgaaaaagtcaaagacatgagatctcatctcatcaagctttgtggtgaagccgaaggttatttagagcaacacttttcagcaatcttaggctcttttgaagacaaccctctaaaccatttacacatcttcccctattacaacaactatctcaaactaggcaaactcgaattcgatctcctatctcaacacacaacccatgtcccgaccaaagtcgcctttattggttccggtccgatgccacttacttccatcgtcttggccaagttccacctccccaacacaacgttccacaacttcgacatcgactcacacgccaacacactcgcttcaaacctcgtttctcgtgattctgacctttccaaacgcatgattttccacacaactgatgtattaaacgctaaggaggggttagaccaatacgatgttgttttcttggcagctcttgttgggatggataaagagtcaaaggtcaaagctattgagcatttagagaagcatatggctcctggagctgtggtgatgctaagaagtgctcatggtcttagagctttcttgtatccaatcgttgactcttgtgatcttaaagggtttgaggtgttaaccatttatcatccgtctgacgacgtggttaattcggtggtcatcgcacgtaagcttggtggttcaaatggagctcgaggcagccagatcggacggtgtgtggttatgccttgtaattgctctaaggtccacgcgatcttgaacaatcgtggtatggagaagaatttgatcgaggagtatagtgccatcgagtaa

SEQ ID NO: 4428 - DNA, 1577 bp, Brassica napus
tatcgtgcaaagcagtggtatcaacgcagagtgcattacgtgcggggattcaaaagcaaaatatttctaaacagagagaaagaagtaagaaatggcgaccacccccatgtgcactgagtggcagttcagcgggaacgaggcagccaaagaagctgctgcggccgccctaggtgcctacacctctaaactcatggctctttgtgatcctaatggcaagcccattttgcccccgagtaacaaggccgtggagaccagcaattcagcggaaaaggctgtcgttaaagttattctctccggcactggaaacgcctatgctcctagcattggccttccgctcgccaaaagtgccgtagcagagtatctaaacagagatcttccaaagaagctaacagcagctgacgtgtttatgactgttggatgcaaacgagcaattgaccttgcggtggatattctggctaaaccaaaagccaacgttttgcttccgaggccaggcttcccgtgggatgtagtacgctgcatctataagaaactcgaggtccgttactatgatttcatccctgaacaaaactttgagatcgacttcgaaagcgtcaaaaaggtgacagacaagaacacctttgctatatttatcatcaaccctcacaatcccaatggaaacacttactcggaggctcatctcaaacagctcgctgaattggctaaggaactctcgattatggtggtttctgatgaagtttttagatggaccgtcttcgggaataacccttttgtgccgatgggaaagttttcttccatcgtaccagtggttacactcggatccttatctaagggatggaatgtcccaggatggcgaactggctggctcgcgctgcacgatctagacggtgtcttcagaaacactaagatattacaagctgccaacgaatttctccagataaatgccaaacctccgactgttattcaggcggctatgcctgacattttggagagaactccaaaacatttcttccacgagaggggaagttttctcaaacataaagtagatattggatattctaaggtcaagcacatacctggcctcacttgttacatgaaacccgaagcgtgcacctttttatggaccaagctggatatatcgtgctttgctgacattgaagacgatcaagacttctgcaggaagcttgctatggaagaaaatctcgtcgttttgccagggattgcatttaggcagaagaattggctgaggcattctatcgacatggagacgccaacagttgaggacgcatttgaaagattgaagagcttctgtgaacgccattccgctgaacgtggagcttcactcaaaaacgtcaatggcgtgaactagagggtcaacatgatgatctttgcctacgtctaattacatatgctataataataaatgggtgttttcagttcaaaaaaataaaataaatgggtgtttttggtaatgtgagataaatcatgaacactttcgtatttgtaacaaataaaattggtgtacttatcatcaatctagaatgttttctcataatgtagctactttcgaataataaaat

SEQ ID NO: 4429 - DNA, 2190 bp, Brassica napus
tgaatctgatctacagtagtatatggcgattttaataccggcacccgctgaagctctcaccgtggtggtcggtcgcatctatatctagaggattcaaaagcaaaatatttctaaacagagagaaagaagtaagaaatggcgaccacccccatgtgcactgagtggcagttcagcgggaacgaggcagccaaagaagctgctgcggccgccctaggtgcctacacctctaaactcatggctctttgtgatcctaatggcaagcccattttgcccccgagtaacaaggccgtggagaccagcaattcagcggaaaaagctgtcgttaaagttattctctccggcactggaaacgcctatgctcctagcattggccttccgctcgccaaaagtgccgtagcagagtatctaaacagagatcttccaaagaagctaacagcagctgacgtgtttatgactgttggatgcaaacgagcaattgaccttgcggtggatattctggctaaaccaaaagccaacgttttgcttccgaggccaggcttcccgtgggatgtagtacgctgcatctacaagaaactcgaggtccgttactatgatttcatccctgaacaaaactttgagatcgacttcgaaagcgtcaaaaaggtgacagacaagaacacctttgctatatttatcatcaaccctcacaatcccaatggaaacacttactcggaggctcatctcaaacagctcgctgaattggctaaggaactctcgattatggtggtttctgatgaagtttttagatggaccgtcttcgggaataacccttttgtgccgatgggaaagttttcttccatcgtaccagtggttacactcggatccttatctaagggatggaatgtcccaggatggcgaactggctggctcgcgctgcacgatctagacggtgtcttcagaaacactaagatattacaagctgccaacgaatttctccagataaatgccaaacctccgactgttattcaggcggctatgcctgacattttggagagaactccaaaacatttcttccacgagaggggaagttttctcaaacataaagtagatattggatattctaaggtcaagcacatacctggcctcacttgttacatgaaacccgaagcgtgcacctttttatggaccaagctggatatatcgtgctttgctgacattgaagacgatcaagacttctgcaggaagcttgctatggaagaaaatctcgtcgttttgccagggattgcatttaggcagaagaattggctgaggcattctatcgacatggagacgccaacagttgaggacgcatttgaaagattgaagagcttctgtgaacgccattccgctgaacgtggagcttcactcaaaaacgtcaatggcgtgaactagagggtcaacatgatgatctttgcctacgtctaattacatatgctataataataaatgggtgttttcagttcaaaaaaataaaataaatgggtgtttttggtaatgtgagataaatcatgaacactttcgtatttgtaacaaataaaattggtgtacttatcatcaatctagaatgttttctcataatgtagctactttcgaataataaaattaatatgtcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcgcgcccgggaaaacccaggctttacccacctgggtcgcggggccatatttccctttttgggggccggaaaaaatatcgaaggggcccgtttttaaaacccttcggaggggaaaacccccgggggcccccaaaaaaaagcgggggggaacaccccccttttcccgaggggggcgaaaaaaaaaaggggcccgccggctcccctttcaaacaacctaacccccgcgagggggggtggggtccccccctggaggcccaaaataacgggggggggggggggggccaacctcggggggtccctttatggtgcccactccgggccccccgtttcccggttcccacaaattttattgcccccgatggggcgggttatcccccaaaa

SEQ ID NO: 4430 - DNA, 1284 bp, Brassica oleracea
atggcgataatggcgaccacccccatgtgcactgagtggcagttcagcgggaacgaggcagccaaagaagctgctgcggccgccctaggtgcctacacctctaaactcatggctctttgtgatcctaatggcaagcccattttgcccccgagtaacaaggccgtggagaccagcaattcagcggaaaaggctgtcgttaaatttattctctccggcactggaaacgcctatgctcctagcattggccttccgctcgccaaaagtgccgtagcagagtatctaaacagagatcttccaaagaagctaacagcagctgacgtgtttatgactgttggatgcaaacgagcaattgaccttgcggtggatattctggctaaaccaaaagccaacgttttgcttccgaggccaggcttcccgtgggatgtagtacgctgcatctataagaaactcgaggtccgttactatgatttcatccctgaacaaaactttgagatcgacttcgaaagcgtcaaaaaggtgacagacaagaacacctttgctatatttatcatcaaccctcacaatcccaatggaaacacttactcggaggctcatctcaaacagctcgctgaattggctaaggaactctcgattatggtggtttctgatgaagtttttagatggaccgtcttcgggaataacccttttgtgccgatgggaaagttttcttccatcgtaccagtggttacactcggatccttatctaagggatggaatgtcccaggatggcgaactggctggctcgcgctgcacgatctagacggtgtcttcagaaacactaagatattacaagctgccaacgaatttctccagataaatgccaaacctccgactgttattcaggcggctatgcctgacattttggagagaactccaaaacatttcttccacgagaggggaagttttctgaaacataaagtagatattggatattctaaggtcaagcacatacctggcctcacttgttacatgaaacccgaagcgtgcacctttttatggaccaagctggatatatcgtgctttgctgacattgaagacgatcaagacttctgcaggaagcttgctatggaagaaaatctcgtcgttttgccagggattgcatttaggcagaagaattggctgaggcattctatcgacatggagacgcaaacagttgaggacgcatttgaaagattgaagagcttctgtgaacgccattccgctgaacgtggagcttcactcaaaaacgtcaatggcgtgaactag

SEQ ID NO: 4431 - DNA, 1514 bp, Raphanus sativus
gggattcaaaagcaaaatctacatagagagaaagaagtaagtaatggcaaccacccccaagtgcactgagtggcagttcagcggtagcgaggcagccaaagaagctgctgcggccgccctaggtgcctacacctctaaactcatggctctttgtgatcctaatggcaagcccattttgcccccaaacaaaaaggccatagagaccagcaattcagccgaaaaagctgtcgttaaagttgttctctccggcaccggaaacgcctatgctcctagcattggccttcccgtcgcaaaaagtgccgtagcagagtatctaaaccgagatcttccgaagaagctaacagcagatgacgtgtttatgactgttggatgcaaacgagcgattgaccttgcggtcgatattcttgctaaaccaaaagccaacgttctgcttccgaggccaggcttcccatgggatgtagtacgctccatctacaagaagctcgaggtccgttactatgattttatccctgaacaaaactttgagatcgacttcgaaagcgtcaaaaaggtgacagacaagaacacgtttgctatatttatcatcaaccctcacaatcccaatggaaacacctactcggaggctcatctcaaacagctcgctgaattggctaaggaactctccattatggtggtttctgatgaagtttttagatggaccgtcttcgggaataacccttttgttccgatgggaaagttttcttccatcgtaccagtggttacactcggatccttatctaagggatggaatgtaccaggatggcgaactggctggctcgcgctgcacgatctagacggtgtcttcagaaacactaagatattagaagctgccaacgaatttctccagataaatgccaaacctccgactgttattcaggcggctatgcctgacattttggagagaactccaaaacatttcttccttgagaggggaagttttctgaaacataaagttgatattggatacgctaagctcaagcacatacctggcctcacttgttacatgaaacccgaagcgtgcacctttttatggaccaagctggatatatcgtgctttgctgacattggagacgatcaagagttctgcagcaagcttgctatggaagaaaatctcgtcgttttgccagggattgcatttagacagccgaactggttgaggcattctatcgacatggagacgccaacagttgaggacgcatttgaaagattgaagagcttctgtgaacgccattccacaaaaggtggagcttcactcaaaaacgccaatggcgtcaactaaagggtcaagatgatatgatccttgtccaagtctatcaatgataataaatgggtgtttttggtaatgtgagataaatcatgaacactttcgtagttgtaataaataaaattggtgtacttatcatcaatcgtagaatgttttctcatgatgtatcatctacttgaataataaaattaatatgtaccaaattctgttt

SEQ ID NO: 4432 - DNA, 1536 bp, Thellungiella halophila
gaatcacccaaaaacaaaatcttaaaagagagaactaagtaagaaatgatgaaccaaaagtgcattgagtggcagttcagcgggagcgaggcggccaaagaagctgccgcagcttccctaggcacctacacctctgaactctacgctatgtgtgatcctaatggcaagcccattttgcccccaagaagcgagtcaccagagaccagccctgcagctgaaaaagctgttgttaaagccgttctatgcggcacgggaaacgcctacgctcctagcattggccttccggtcgccaaacgtgccgtagcagaatatctaaaccaaaatcttccgaagaagctaacagcagatgacgtgtttatgactgtgggatgcaaacaagcgatcgagctcgctgtggacattcttgctaaaccgaaagccaacgttttgcttccaaggccaggcttcccttgggacgtagtccgctccatctacaagcaccttgaggtccgctactatgacttcatccctgaaaaagactttgagatcgacttcgatagcgtgagaaagatggtagacaagaacacgtttgccatatttataataaacccccacaatcccaatgggaacacctactccgagtgtcatctcaagcagcttgctgagttggctaaggaactctcgataatggtggtttctgatgaagtttatagatggacagtctttgggagtaacccttttgttccgatgggaaaattctcgtcaatcgtaccagtggttacactcggatccatatctaagggttggagtgtccctggatggcgaactggctggctcgcgctgcatgatctagatggcgtcttcaaaagcaccaagatcttacaagctgccaaagaatttctcgagataaactctaaacctccaactgttattcaggcggctattcctgatattttggagagaactcctaaagagttcttcgataagagggggagttttctgaaagataaagtagattttggatattctaagctcaagcacatacctaacctcacctgctacatgaaacctgaagcttgcaccttcttatggaccgagctggatttatcgtgctttgtgagcattgaagacgatcaagacttctgcaagaagcttgctatggaagaaaaccttgttgttttaccagggattgcattcagtcagaagaattggctgaggcattctattgacatggacactccaactttggaggatgcgtttgaaagattgaagagtttctgtgaacgccattccattacaggtgaagcttcacttaaaaacgtcaatggcgtcaactaaatgacccgtatgtctcttcgcccaagtctttttacacatgctctattaataaataaaaaatgtgtaatgtatggatttgagttaaatcatgaacactttcatatttttaataacaaataaaatgggtgtgcttatcatcatcagtcctgtaattttttttttttggttaaaacaatcgtgtattgtttctcattaataaattccagattattttcactt

SEQ ID NO: 4433 - DNA, 724 bp, Brassica rapa
  misc_feature (719)..(719): n is a, c, g, or t
gaagaaagaaacattacttgcgaccaaaaattacagattcttgaaactattagtgttgatacttgatagataccatgggcttactagatcatctctgggatgataccgtcgctggtcctaggccagagaacggccttggcaagcttcggagacaccataccttcagtttccggcctagctccggtaatgatcaatcggacggtggaagcgtgagatcgtacggtgaagaatcaccggaggaggccgtgaaagtgacacgtagcatcatgataataaaaccaccgggataccaaggcggttcagctccggtttcaccagccggttcaactccgccagtatctcctttctctgagcaaacgcaggaggaaaggaaccctttcggtttaggagaaggtcgacgtcggacgcgttcgataagggagcaggatcagagaatggaccaaggaactctcctcctacttacggcctgtgatctataactcaaatctcaatagggagagagaaaagaagaagagtagcccccaaaacgctttcgatcaagtggtccttgcatgcagagttcgtgttgcttccgtttgtaggccaaagaggttctctcttttgtgtgcgtgtatgagtttgttttgtgtgtttgtggttacgtctatgtttttgtttttgtatgtcatctcgttttgggaatgcttctacgtgtctgtacatattttgctgcaatgatnataaa

SEQ ID NO: 4434 - DNA, 764 bp, Brassica napus
gtggtatcaacgctagtagtacgcgggggaagaaagaaacattacttgcgaccaaaaattacagattcttgaaactattagtgttgatacttgatagataccatgggcttactagatcatctctgggatgataccgtcgctggtcctaggccagagaacggccttggcaagcttcggagacaccataccttcagtttccggcctagctccggtaatgatcaatcggacggtggaagcgtgagatcgtacggtgaagaatcaccggaggaggccgtgaaagtgacacgtagcatcatgataataaaaccaccgggataccaaggcggttcagctccggtttcaccagccggttcaactccgccagtatctcctttctctgagcaaacgcaggaggaaaggaaccctttcggtttaggagaaggtcgacgtcggacgcgttcgataagggagcaggatcagagaatggaccaaggaactctcctcctacttacggcctgtgatctataactcaaatctcaatagggagagagaaaagaagaagagtagcccccaaaacgctttcgatcaagtggtccttgcatgcagagttcgtgttgcttccgtttgtaggccaaagaggttctctcttttgtgtgcgtgtatgagtttgttttgtgtgtttgtggttacgtctatgtttttgtttttgtatgtcatctcgttttgggaatgcttctacgtgtctgtacatattttgctgcaatgataataaaaatgtgtagatg

SEQ ID NO: 4435 - DNA, 756 bp, Brassica napus
ttacttgcgaccaaaaattacagattcttgaaactattagtgttgatacttgatagataccatgggcttactagatcatctctgggatgataccgtcgctggtcctaggccagagaacggccttggcaagcttcggagacaccataccttcagtttccggcctagctccggtaatgatcaatcggacggtggaagcgtgagatcgtacggtgaagaatcaccggaggaggccgtgaaagtgacacgtagcatcatgataataaaaccaccgggataccaaggcggttcagctccggtttcaccagccggttcaactccgccagtatctcctttctctgagcaaacgcaggaggaaaggaaccctttcggtttaggagaaggtcgacgtcggacgcgttcgataagggagcaggatcagagaatggaccaaggaactctcctcctacttacggcctgtgatctataactcaaatctcaatagggagagagaaaagaagaagagtagcccccaaaacgctttcgatcaagtggtccttgcatgcagagttcgtgttgcttccgtttgtaggccaaagaggttctctcttttgtgtgcgtgtatgagtttgttttgtgtgtttgtggttacgtctatgtttttgtttttgtatgtcatctcgttttgggaatgcttctacgtgtctgtacatattttgctgcaatgataataaaaatgtgtagatgcttaacatcacttctttttggacaccacagtct

SEQ ID NO: 4436 - DNA, 790 bp, Raphanus sativus
gggaagaaagaaacataactcgcgaccaaaaaaatttgcagattcttgaaaactattagggttgatttgattcatgggcttactagatcatctctgggatgataccgtcgctggtcctcggccagataacggccttggcaagcttcggagacaccataccttcagtttccggcctagctccggcaatgatcaatcggacggtggaagcgtgagatcgtacggtgaagtatcaccagaggaggccgtgaaggtaacacgcagcatcatgataataaaaccaccaggataccaaggcggttcagctccggtttcaccggccggttcaactccgccggtatctcctttctctgagcaaacgcaggaggaaaggaaccctttcggtttaggagaaggtcgacgtcggacgcgttcgataagggagcaggatcagagaatggaccaaggaactctcctcctacttacggcctgtgatctctaatctctaactcaaatgagagaaagaagaagaaaaagaacagagtagctccccaacacgctttcgtttagacgacacatcaatcaagtggtccttccttgcatgcagagttcgtgtttcttccgtttgtaggcctaaagaggttctctttttgtgtgtgtttgtgcgtgtatgagtttgttctctgtgtgtgtgtgttgtgaatacgtctctgtttttttttcctttctttttctgtatgtcatctcgctttcgcagtgcttctacgtgtctgtacatatttgctggagtgataataaaaataagtagatgctt

SEQ ID NO: 4437 - DNA, 774 bp, Raphanus sativus
  misc_feature (16)..(16): n is a, c, g, or t
  misc_feature (245)..(245): n is a, c, g, or t
  misc_feature (275)..(275): n is a, c, g, or t
  misc_feature (570)..(570): n is a, c, g, or t
gaaagaaacataactngcgaccaaaagttacagattcttgaaaactattagggttgatttgattcatgggcttactagatcatctctgggatgataccgtcgctggtcctcggccagagaacggccttggcaagcttcggagacaccataccttcagtttccgacccagctccaccaatgatcaatcggacggtggtagcgtgagatcgtacggtgaagaatcaccggaggaggccgtgaaagtnacacgcagcatcatgataataaaaccaccnggataccaaggcggttcagctccggtttcaccggccggttcaactccgccggtatctcctttctctgagcaaacgcaggaggaaaggaaccctttcggtttaggagaaggtcgacgtcggatgcgttcgataagggagcaggatcagagaatggaccaaggaactctcctcctacttacggcctgtgatctctaatctctaactcaaatgagagagaagaagaagaaaaagaacagagtagctccccaacacgctttcgtttagacgacacatcaagtggtccttccttgcatgnagagttcgtgtttcttccgtttgtaggcctaaagaggttctctttttgtgtgtttgtgcgtgtatgagtttgttctctgtgtgtgtgtgttgtgaatacgtctctgtttttttttcctttctttttctgtatgtcatctcgctttcgcagtgcttctacgtgtctgtacatatttgctggagtgataataaaaatacgtagatg

SEQ ID NO: 4438 - DNA, 744 bp, Brassica oleracea
acgcgtccgcggacgcgtcggcttgcgaccaaaaattacagattcttgaaactattagggttgatacttgataccatgggcttactagatcatctctgggacgataccgtcgctggtcctcggccagagaacggccttggcaagcttcggagacaccataccttcagtttccgggctagctccggcaatgatcaatcggacggtggtagcgtgagatcgtacggtggagattcgccggaagaggccgtgaaagtaacacgcagcatcatgataataaaaccaccaggataccaaggcggttcagctccggtttcaccggccggttcaactccgccagtgtctcctttctctgagcaaacgcaggaggaaaggaaccctttcggtttaggagaaggtcgacgtcggacgcgttcgataagggagcagaatcagagaatggaccaaggaactctcctcctacttacggcctgtgatctctagctcaaatctcaatagggagagagaagaaacagagtagccctcaaaacgctttcgatcaagtggtccttgcatgcagagttcgtgttgcttccgtttgtaggccaaagaggttctctcttttgtgtgcgtgtatgagtatgttttgtgtgtttgtggttacgtctctgtttttctttttgtatgtcatctcgttttgggaatgcttctacgtgtctgtacatattttgctgcaatgataataaaaatgtgtagatgcttaacatc

SEQ ID NO: 4439 - DNA, 773 bp, Brassica napus
gtcccgggattcggccttatgtccggggaagaaagaaacattacttgcgaccaaaaactacaaattcttgaaactattaggagtgatacttgataccatgggcttactagatcatctctgggacgataccgtcgctggtcctaggccagagaacggccttggcaagctccggagacaccataccttcagtttccgggctagctccggcaatgatcaatcggacggtggtagcgtgagatcgtacggtggagattcgccggaagaggccgtgaaagtaacacgcagcatcatgataataaaaccaccaggataccaaggcggttcagctccggtttcaccggccggttcaactccgccagtgtctcctttctctgagcaaacgcaggaggaaaggaaccctttcggtttaggagaaggtcgacgtcggacgcgttcgataagggagcagaatcagagaatggaccaaggaactctcctcctacttacggcctgtgatctctagctcaaatctcaatagggagagagaagaaacagagtagcccccaaaacgctttcgatcaagtggtccttgcatgcagagttcgtgttgcttccgtttgtaggccaaagaggttctctcttttgtgtgcgtgtatgagtatgttttgtgtgtttgtggttacgtctctgtttttctttttgtatgtcatctcgttttgggaatgcttctacgtgtctgtacatattttgctgcaatgataataaaaatgtgtagatgcttaacatcacttctt

SEQ ID NO: 4440 - DNA, 767 bp, Brassica napus
gtcccgggattcggccttatgtccggggaagaaagaaacattacttgcgaccaaaaactacaaattcttgaaactattaggagtgatacttgataccatgggcttactagatcatctctgggacgataccgtcgctggtcctaggccagagaacggccttggcaagctccggagacaccataccttcagtttccgggctagctccggcaatgatcaatcggacggtggtagcgtgagatcgtacggtggagattcgccggaagaggccgtgaaagtaacacgcagcatcatgataataaaaccaccaggataccaaggcggttcagctccggtttcaccggccggttcaactccgccagtgtctcctttctctgagcaaacgcaggaggaaaggaaccctttcggtttaggagaaggtcgacgtcggacgcgttcgataagggagcagaatcagagaatggaccaaggaactctcctcctacttacggcctgtgatctctagctcaaatctcaatagggagagagaagaaacagagtagcccccaaaacgctttcgatcaagtggtccttgcatgcagagttcgtgttgcttccgtttgtaggccaaagaggttctctcttttgtgtgcgtgtatgagtatgttttgtgtgtttgtggttacgtctctgtttttctttttgtatgtcatctcgttttgggaatgcttctacgtgtctgtacatattttgctgcaatgataataaaaatgtgtagatgcttaacatca

SEQ ID NO: 4441 - DNA, 701 bp, Raphanus sativus
tcatgggcttactagatcatctctgggatgataccgtcgctggtcctcggccagataacggccttggcaagcttcggagacaccataccttcagtttccggcctagctccgtcaatgatcaatcggacggtggaagcgtgagatcgtacggtgaagtatcaccagaggaggccgtgaaggtaacacgcagcatcatgataataaaaccaccaggataccaaggcggttcagctccggtttcaccggctggttcaactccaccggtatctcctttctcttggaggaaaggaaccctttcggtttaggagaaggtcgacgtcggacgcgttcgataagggagcaggatcagagaatggaccaaggaactctcctcctacttacggcctgtgatctctaatctctaactcaaatgagagaaagaagaagaaaaagaacagagtagctccccaacacgctttcgtttagacgacacatcaagtggtccttccttgcatgcagagttcgtgtttcttccgtttgtaggccaaacgaggttctctttttgtgtgtgtttgtgcgtgtatgagtttgttctgtgtgtgtgtgttgtgaatacgtctctgttttttttttcctttctttttctgtatgtcatctcgctttcgcagtgcttctacgtgtctgtacatatttgctggagtgataataaaaatacgtagatg

SEQ ID NO: 4442 - DNA, 791 bp, Thellungiella halophila
ggatctctctctacaacatctgtgaaaaacctaacttgcgcccaaaagttttagattcttgaaaaacaaattagggttgataacttttgatccatgggcttacttgatcatctgtgggatgacaccgtcgctggtcctcggccagagaatggccttggcaagcttcggaaacaccataccttcagtttccggcctagctccggcaatgatcaatcggacggtggaagcgtgagatcgtacggtgaggattcgccggaagaagccgtgaaagtaacacgcagcatcatgatagtaaaaccaccagggtaccaaggcggttcagctccggtttcgccggccggttcaaccccgccagtgtctcctttctctggaggaaaggaaccctttcggtttaggagaaggtcgacgtcggatgcgttcgataaggcagcaggatcagagagtggaccaaggagctctcctcctacttacggcgtgtgatctctaacccaacaatgttgtcccaaaagagaaagcagaagaagcagagtacgtaccctgagacgctgtcgttttgtcactcaagtggtcgttgcagaaattcgtgttctttttttttttttttgtaggccaaattaaagaggttttcttttgtgtgtgtgcgtgtaagagtttgtttgtgtgttttgtgattatgtctctgttttctttttctttttcttttttgtatgtcatatcgttttcgcaatgcttctacgcttttgtacattttttgctgcaatgataataaaaatatgtagatgcttaacatc

SEQ ID NO: 4443 - DNA, 721 bp, Brassica oleracea
ggatcactctacaacatttgtggaataattaactattagctttacgatcttgaaactattagggttgataccatggggttactagatcatctttgggatgataccgtcgctggtcctctgccagaaaacggccttggcaagcttcggaaacaccatactttcagtttccggccaagctccgccaatgatcaatcggacgtgaggtcgtacggcggagattcaccggaagaggcagtgaaagtaacacgcagcatcatgataataaaaccaccaggttaccaaggcggttcagctccggtgtcgccggccggttcaactacacccgtatcccccagtcctttctctgagcaaacgcaggaggaaaggaaccctttcggtttaggagaaggtcggcatcggacgcgttcgataaggcagcaggatcagggaatggaccaaggaactctcctcctacttacggcgtgtgatctctaatctcctaaccccaaatctctaaagagagagagagagaagaagaaagaacagagtagagcccccgagacgctttcgttttgacacatcaagtggtccttgcatgcagagttcgtgtttcttcctttggtaggacatagaggttctcttttgtttatgcgtgtatcagtgtattgagtttgtttgcgtgtatgtgattacgtctctgtttatcttctctttttgtatttatatgtcatctcgttttcgt

SEQ ID NO: 4444 - DNA, 687 bp, Raphanus sativus
ggaatctctctcttacacaacatctgcgaagaaacgataactttacttgatccatgggcatactcgatcatctctgggatgataccgtcgctggtcctcggccggagaacggccttggcaagcttcggaaacaccatactttcagtttccggcctagctccggcaatgatcaacctgacagtggaaacgttagatcgtacggtgaagactcgccggatgagggtgtgaaagtgacacgcagcatcatgataataaaaccaccagggtaccaaggcggttcaactccggtttcaccggccggttcaactccaccggtgtctcctttttctgagcaaacgcaggaggaaaggaaccctttcggttcaggagacgctcgacttcggacgcgttcgagaaggcagcaggcagaccagagaatggaccaaggaactctcctcctacttacggcgtgtgatctctaatctctaactagagaagaagaagaggaaacagagtcgcccctgaagcgctttcgttttgacacatcaagtggtcgttgcatgcagagctcgtctttcttccttttgtaggctagagaggttctcttttgtttatgcgtgtgtgaggttgttcccgcgtttgtgattccgtctctgttttttctctctctttttgttcctttttatatgtcagctcgttttcgcaatg

SEQ ID NO: 4445 - DNA, 788 bp, Raphanus sativus
  misc_feature (8)..(8): n is a, c, g, or t
  misc_feature (16)..(17): n is a, c, g, or t
  misc_feature (21)..(21): n is a, c, g, or t
  misc_feature (28)..(28): n is a, c, g, or t
  misc_feature (37)..(38): n is a, c, g, or t
gggaatcnctctcttnnacancatctgngaagaaaannataacttttacttgatccatgggcatacttgatcatctctgggatgataccgtcgctggtcctcggccggagaacggccttggcaagcttcgtaaacaccatactttcagtttccggcctagctccggcaatgatcaatctgacggtggaagcgtgagatcgtacggtgaagactcgccggatgagggtgtgaaagtgacacgcagcatcatgataataaaaccaccagggtaccaaggcggttcagctccggtttctccagccggttcaactccaccggtgtctcctttctctggagggaaggaaccctttcggttcaggagacgctcgacttcggacgcgttcgagaaggcagcaggcagatcagagaatggaccaaggaactctcctcctacttacggcgtgtgatctctaatctctaactagagaagaagaagaagaaacagagtagcccctgaaggctgaagcgctttcgttttgacacatcaagttggtcgttgcatgcagagttcgtctttcttccttttgtaggctagagaggttctcttttgtttatgcgtttgtgaggttgttcccgcgtttgtgattgcgtctctgttttttttttctctctttttgtttgtttttatatgtcatctcgttttcgcaatgcttttacgtgtctgtacatatttgctgcaatgataataaacatattaatgtagatgcttgacattagttctttttatctatgataatattgattgctta

SEQ ID NO: 4446 - DNA, 756 bp, Brassica napus
gatctctctccacagcaacatctgggaaaaaaacataacttgactcgagccatgggcatacttgatcatctctgggatgataccgtcgctggtcctcggccggagaacggccttggcaagcttcggaaacaccataccttcagtttccggcctagctccggcaatgatcaatcggacggtggaaacgtgggatcgtacggtgaagattcgctggacgaaggtttgaaagtgacacgcagtatcatgataataaaaccaccaggataccaaggcggttcagctccggtttcgccggccggttcaactccaccggtttctcctttctctggaggaaaggaaccctttcggttcaggagaaggtcgacctcggacgcgttcgagaaggcagcaggatcagagaatggaccaaggaactctcctcctacttacggcgtgtgatctctaatctctaaccccaaatctttaactagagaaggagaagaagaagaaaaatcagagtaagcgatttcgttttgaatacatcgaactggtcgttgcatgcagagttcgtatttcttccttttgtaagctaagctaagctaaagagcttctcttttgtttaatgcgtgtatgaggttgtttccgtgtttgtgattgcgtctcgccgtctctgtttttttagtttgtgggtatgtgtgtcatctcgttttcgctatgctttctacgtgtctgtacatatttactgcaatgataataaacttatgtagttctttttta

SEQ ID NO: 4447 - DNA, 818 bp, Brassica napus
ccgcaggtgggaccggaccgtatataccgggccgacccacgcgtccgcaacatctgggaaaaaaacataacttgactcgagccatgggcatacttgatcatctctgggatgataccgtcgctggtcctcggccggagaacggccttggcaagcttcggaaacaccataccttcagtttccggcctagctccggcaatgatcaatcggacggtggaaacgtgggatcgtacggtgaagattcgctggacgaaggtttgaaagtgacacgcagtatcatgataataaaaccaccaggataccaaggcggttcagctccggtttcgccggccggttcaactccaccggtttctcctttctctggaggaaaggaaccctttcggttcaggagaaggtcgacctcggacgcgttcgagaaggcagcaggatcagagaatggaccaaggaactctcctcctacttacggcgtgtgatctctaatctctaaccccaaatctttaactagagaaggagaagaagaagaaaaatcagagtaagcgatttcgttttgaatacatcgaactggtcgttgcatgcagagttcgtatttcttccttttgtaagctaagctaagctaaagagcttctcttttgtttaatgcgtgtatgaggttgtttccgtgtttgtgattgcgtctcgccgtctctgtttttttagtttgtgggtatgtgtgtcatctcgttttcgctatgctttctacgtgtctgtacatatttactgcaatgataataaacttatgtagttcttttttatctattgatccactacatccttcactctcc

SEQ ID NO: 4448 - DNA, 759 bp, Brassica napus
gggatcactctacaacatttgtggaataattaactatcagctttacgatcttgaaactattagggttgataccatggggttactagatcatctttgggatgataccgtcgctggtcctctgccagagaacggccttggcaagcttcggaaacaccatactttcagtttccggccaagctcagccaatgatcaatcggacgtgaggtcgtacggcggagattcaccggaagaggcagtgaaagtaacacgcagcatcatgataataaaaccaccaggttaccaaggcggttcagctccggtgtcgccggccggttcaactacacccgtatcccccagtcctttctctggaggaaaggaaccctttcggtttaggagaaggtcggcatcggacgcgttcgataaggcagcaggatcagagaatggaccaaggaactctcctcctacttacggcgtgtgatctctaatctcctaaccccaaatctctaaagagagagagagaagaagaaagaacagagtagcccccgagacgctttcgttttgacacatcaagtggtccttgcatgcagagttcgtgtttcttcctttggtaggacatagaggttctcttttgtttatgcgtgtatcagtgtattgagtttgtttgcgtgtatgtgattacgtctctgtttatcttctctttttgtatttatatgtcatctcgttttcgtaatgtttctacgcgtctgtacagttttgctgcaatgataatgaagttatgta

SEQ ID NO: 4449 - DNA, 788 bp, Brassica napus
gatcgatcactctacaacatttgtggaataattaactatcagctttacgatcttgaaactattagggttgataccatggggttactagatcatctttgggatgataccgtcgctggtcctctgccagagaacggccttggcaagcttcggaaacaccatactttcagtttccggccaagctcagccaatgatcaatcggacgtgaggtcgtacggcggagattcaccggaagaggcagtgaaagtaacacgcagcatcatgataataaaaccaccaggttaccaaggcggttcagctccggtgtcgccggccggttcaactacacccgtatcccccagtcctttctctggaggaaaggaaccctttcggtttaggagaaggtcggcatcggacgcgttcgataaggcagcaggatcagagaatggaccaaggaactctcctcctacttacggcgtgtgatctctaatctcctaaccccaaatctctaaagagagagagagaagaagaaagaacagagtagcccccgagacgctttcgttttgacacatcaagtggtccttgcatgcagagttcgtgtttcttcctttggtaggacatagaggttctcttttgtttatgcgtgtatcagtgtattgagtttgtttgcgtgtatgtgattacgtctctgtttatcttctctttttgtatttatatgtcatctcgttttcgtaatgtttctacgcgtctgtacagttttgctgcaatgataatgaagttatgtagagattcctataacatccgttcttttt

SEQ ID NO: 4450 - DNA, 753 bp, Raphanus sativus
ggggaatctctctcttacacaacatctgcgaagaaatacataacttttacttgatccatgggcatacttgatcatctctgggatgataccgtcgctggtcctcggccggagaacggccttggcaagcttcggaaacaccatactttcagtttccggcctagctccggcaatgatcaacctgacagtggaaacgttagatcgtacggtgaagattcgccggatgagggtgtgaaagtgacacgcagcatcatgataataaaaccaccgggataccaaggcggttcagctccggtttcaccggccggttcaactccaccggtgtctcctttctctggaggaaaggaaccctttcggttcaggagacgctcgacttcggacgcgttcgagaaggcagcaggcagatcagagaatggaccaaggaactctcctcctacttacggcgtgtgatctctaatctctaactagagaagaagaagaggaaacagagtagcccctgaaggctgaagcgctttcgttttgacacatcaagttgtcgttgcatgcagagctcgtctttcttccttttgtaggctagagaggttctcttttgtttatgcgtgtgtgaggttgttcccgcgtttgtgattgcgtctctgtttttttttctctctttttgttcctttttatatgtcaatctcgttttcgcaatgcttttacgtgtctgtacatatttgctgcaatgataataaacatattaatgtagatgcttgacat

SEQ ID NO: 4451 - DNA, 715 bp, Brassica oleracea
gaacgcgtccgcaacaacatctgtgaaaaaacataacttgactcgagccatgggcatacttgatcatctctgggatgataccgtcgctggtcctcggccggagaacggccttggcaagcttcggaaacaccataccttcagtttccggcctagcttcggcaatgatcaatcgggcggtggagattcaccggaagaggctctgaaagtgacacgcagcatcatgataataaaaccaccagggtaccaaggcggttcagctccggtttcgccggccggttcaactccaccggtttctcctttctctgagcaaacgcaggaggaaaggaaccctttcggttcaggagacgctcgacctcggacgcgttcgagaagggaccaggatcagagaatggaccaaggaactctcctcctacttacggcgtgtgatctataatctctaaccccaaatctcaaactagagaagaagaagaagaaacagagtagcccctgaagcgctttcgttttggcacatcaagtggtcgttgcatgcagagttcgtctttcttacttttgtaggctagagaggttctcttttgtttatgcgtgtgtgaggttgttccaatgtttgtgattgcctctctgtttttttttctctctctttttgtttgtttttatatgtcatctcgtattcgcaatgcttctacgtgtctgtacatatttgctgcaatgataataa

SEQ ID NO: 4452 - DNA, 832 bp, Brassica rapa
atcgatcactctctacaacatttgtggaataattaactatttaactttacgatcttgaaactattagagttgatgccatgggcttactagatcatctttgggatgataccgtcgctggtcctctgccagagaacggccttggcaagcttcagaaacaccatactttcagtttccggccaagctccgccaatgatcaatcggacgtgaggtcgtacggcggagattcaccggaagaggcagtgaaagtaacacgaagcatcatgataataaaaccaccaggttaccaaagcggttccgctccggtgtcgccggccggttcaactacaccggtatcccccagtcctttctctggaggaaaggaaccctttcggtttaggagaaggtcggcatcggacgcgttcgataaggcagcaggatcagagaatggaccaaggaaatctcctcctacttacggcgtgtgatctctaatctcctaaccccaaatctctaaagagagagagagagaagaagaaagaacagagtagcccccgagacgctttcgttttgacacatcaagtggtccttccatgcagagttcgtgtttcttcctttggtaggacatagaggttctcttttgtttatgtgtgtatcaatcagtgtattgagtttgtttgcgtgtatgtgattacgtgtatcttctctttttgtatttatatgtcatctcgttttcgtaatgcttctacgcgtctgtacagttttgctgcaatgataatgaagttatgtagagagattcttataacattcgttctttttttttatctagtgatccatccactacatcaaaaaaaaaaaa

SEQ ID NO: 4453 - DNA, 679 bp, Raphanus sativus
  misc_feature (485)..(485): n is a, c, g, or t
  misc_feature (501)..(501): n is a, c, g, or t
  misc_feature (546)..(546): n is a, c, g, or t
  misc_feature (604)..(604): n is a, c, g, or t
ttgatccatgggcatactcgatcatctatgggagataccgtcgctggtcctcggccagagaacggccttggcaagcttcgtaaacaccataccttcagtttccgacctagctccggcaatgatcaacctgacagtggaaacgttagatcgtacgatgaagactcgccggatgagggtgtgaaagtgacacgcagcatcatgataataaaaccaccagggtaccaaggcggttcaactccggtttcaccggccggttcaactccaccggtgtctcctttctctggaggaaaggaaccctttcggttcaggagacgctcgacttcggacgcgttcgagaaggcagcaggatcagagaatggaccaaggaacactcctcctacttacggcgtgtgatctctaatctctaactagagaagaagaagaggaaacagagtagcccctgaagcgctttcgttttgacacatcaagtggtctttgcatgcagngctcgtctttcttccntttgtaggctagagaggttctcttttgtttatgcgtttgtgaggntgttcccgcgtttgtgattgcgtctctgtttttttttctctctttttgttcctttttntatgtcatctcgttttcgcaatgcttctacgtgtctgtacatatttgctgcaatgataataaacatattaatgta

SEQ ID NO: 4454 - DNA, 438 bp, Brassica napus
gatctctctctccacaaaaacataacataacttgactcgagccatgggcatacttgatcatctccgggatgataccgtcgctggtcctcggccggagaacggccttggcaagcttcggaaacagcatactttcagtttccggcctagctccggcaatgatcaatcggacggtggagattcaccggaagaggctctgaaagtgacacgcaacatcatgataataaaaccaccagggtaccaaggcggttcagctccggtttcgccggccggttcaaccccaccggtttctcctttctctgagcaaacgcaggaggaaaggaaccctttcggttcaggagacgctcgacctcggacgcgttggagaaggaaccaggatcagagaatggaccaaggaactctcctcctacttacggcgtgtgatctataatctctaacccc

SEQ ID NO: 4455 - DNA, 707 bp, Brassica rapa
aatctctctctccacaaaaacataacttgactcgagatatgggcatacttgatcatctctgggatgataccgtcgctggtcctcggccggagaacggccttggcaagcttcggaaacagcatactttcagtttccggcctagctccggcaatgatcaatcggacggtggagattcaccggaagaggctctgaaagtgacacgcagcatcatgataataaaaccaccagggtaccaaggcggttcagctccggtttcgccggccggttcaaccccaccggtttctcctttctctggaggaaaggaaccctttcggttcaggagacgctcgacctcggacgcgttggagaaggaaccaggatcagagaatggaccaaggaactctcctcctacttacggcgtgtgatctataatctctaaccccaaatctcaaactagagaagaagaagaagaagaaacagagtagcccctgaagcgctttcgttttgacacatcaagtggtcgttgcatgcagagttcgtctttcttacttttgtaggctagagaggttctcttttgtttatgcgtgtgtgaggttgttcccgtgtttgtgattgcctctctgtttttttctctctttttgtttgtttttatatgtcatctcgtattcgcaatacttcaacgtgtctgtacatatttgctgcaatgataataaacatattaatgtaga

SEQ ID NO: 4456 - DNA, 745 bp, Brassica napus
gggaatctctctctccacaaaaacataacataacttgactcgagccatgggcatacttgatcatctctgggatgataccgtcgctggtcctcggccggagaacggccttggcaagcttcggaaacagcatactttcagtttccggcctagctccggcaatgatcaatcggacggtggagattcaccggaagaggctctgaaagtgacacgcagcatcatgataataaaaccaccagggtaccaaggcggttcagctccggtttcgccggccggttcaaccccaccggtttctcctttctctggaggaaaggaaccctttcggttcaggagacgctcgacctcggacgcgttggagaaggaaccaggatcagagaatggaccaaggaactctcctcctacttacggcgtgtgatctataatctctaaccccaaatctcaaactagagaagaagaagaagaagaagaagaagaaacagagtagcccctgaagcgctttcgttttgacacatcaagtggtcgttgcatgcagtgcagagttcgtctttcttacttttgtagactagagaggttctcttttgtttatgcgtgtgaggttgttcccatgtttgtgattgcctctctgttttttttttttctctttttgtttgtttttatatgtcatctcgtattcgcaatacttcaacgtgtctgtacatatttgctgcaatgataataaacatattaatgtagatgcagatgcttgaca

SEQ ID NO: 4457 - DNA, 824 bp, Cleome spinosa
cagtcgttcctctaacgtgcgccgggaaaaccatttcccttgttatcgtgcgccttcgtttttttgttttgtctaacctgcgccccatctccatgggcttactcgaccatctctgggatgacaccgtcgctggtccgcggccggagaacggcctcggaaagcttcggaagcatcacacctttagtttccggccaagctccggcaatgatcaatcggagggtgggagtgtgagatcgtacggtgaggactcgccggaggaggcggtgaaagtcacgcgcagcatcatgatagtgaagccgccgggataccaggggggttcagctccggtttcgccggccggctctacacctccggtttctcctttctctggaggggggaaggaaccctttcggttcagaaggaggtcgacctcggacgcattcgagaaggcaaacgacgaggctggacgaccaaggagctctgctcctccttacggcgtgtgacatctaagctaaaaaaactctacgccaccccccgtgacaaacaaatggtaaacttgtcatttcaccacgtccccccaccccccatgcaagctttttttttttttgaggaaaaagagagagacaggcgtctacttgtgatatcttgcggtgggtctgtcttggttgctgtgtttggtggttttggttttgtgtgttatggtgcttgcttctcctgtcttttatgtttgatgctataaagatgtaatctttctcttagggttttggttaatgtaatgtgtatgtgtatgtgtatgtatgtacatacgtatatgtaaattttgcctcaataaattcaactttttt

SEQ ID NO: 4458 - DNA, 1013 bp, Arabidopsis thaliana
ttaaactcaatcaagataaagctaaggacacactcgtaaatacaaaaaagaaagcgacagatgcgatcacgtgagatgcatttataaccctccgatgaaaatccacgtggcactccgatctaaatatctcgaccatatcgggtcccacacttccaatcctcgaccttatccaccttacgtagacctaatatccagtcgccacgtcacacacaatcaacgtctcagatgtacccgatcgcctttaaatcatcgcttccttcatgaatcgaagaacctctacaacaacagattttaaaaaaccccaaaaactttacattcttaacaatttcaaccctatgggcttacttgatcatctctgggatgatactgtcgctggtccacggccagagaacggccttggcaagcttcgtaaacaccataccttcagtttccgacctagctccggcaatgatcaatcggaagctggaagtgcgagatcgtacggtgaggattcgctaccggaagaagcagtgaaagttacacgtagtatcatgataattaaaccaccgggttaccaaggcagttcagctccagcttcgcctgccggttcaactccgccgctatcacctttctctccgccgctgtctccgttctctgggggaaaggaaccctttcggtttaggagacggtcgacgtcggatgcgttcgagaaggcagcaggaggatcagagactggaccaaggagctctcctcctacttacggcatgtgatctctaacacacaacacaagtcttgaaaaagagaagagaagaagaaaacagagtacccacccttaaacgatgtcgtttagactgcatgaagtggtggtttttttgcttttgtaggccaaagaggtgttcagtgttctcttatgtatgcgtgtatgagtttgtttgtgtgtttgttttttatatgtaatctcgtttttttcggtaatgcttttatgcgttttgtaaatttttgctgcaatgaaaataaaaacttgtagatactta

SEQ ID NO: 4459 - DNA, 1012 bp, Arabidopsis thaliana
ttaaactcaatcaagataaagctaaggacacactcgtaaatacaaaaaagaaagcgacagatgcgatcacgtgagatgcatttataaccctccgatgaaaatccacgtggcactccgatctaaatatctcgaccatatcgggtcccacacttccaatcctcgaccttatccaccttacgtagacctaatatccagtcgccacgtcacacacaatcaacgtctcagatgtacccgatcgcctttaaatcatcgcttccttcatgaatcgaagaacctctacaacaacagattttaaaaaaccccaaaaactttacattcttaacaatttcaaccctatgggcttacttgatcatctctgggatgatactgtcgctggtccacggccagagaacggccttggcaagcttcgtaaacaccataccttcagtttccgacctagctccggcaatgatcaatcggaagctggaagtgcgagatcgtacggtgaggattcgctaccggaagaagcagtgaaagttacacgtagtatcatgataattaaaccaccgggttaccaaggcagttcagctccagcttcgcctgccggttcaactccgccgctatcacctttctctccgccgctgtctccgttctctgggggaaaggaaccctttcggtttaggagacggtcgacgtcggatgcgttcgagaaggcagcaggaggatcagagactggaccaaggagctctcctcctacttacggcatgtgatctctaacacacaacacaagtcttgaaaaagagaagagaagaagaaaacagagtacccacccttaaacgatgtcgtttagactgcatgaagtggtggtttttttgcttttgtaggccaaagaggtgttcagtgttctcttatgtatgcgtgtatgagtttgtttgtgtgtttgttttttatatgtaatctcgtttttttcggtaatgcttttatgcgttttgtaaatttttgctgcaatgaaaataaaaacttgtagatactt

SEQ ID NO: 4460 - DNA, 728 bp, Brassica napus
ctctacaacatttgtggaataattaacaattaactctacgatcttgaaactattagggttgataccatggggttactagatcatctttgggatgataccgtcgctggtcctctgccagagaacggccttggcaagcttcggaaacaccatactttcagtttccggccaagctccgccaatgatcaatcggaggtgaggtcgtacggcggagattcaccggaagaggcagtgaaagtaacacgaagcatcatgataataaaaccaccaggttaccaaagcggttccgctccggtgtcgccggccagttcaactacaccggaggaaagaaaccctttcggtttaggagaaggtcggcatcggacgtgttcgataaggcagcaggatcagagaatggaccaaggaactctcctcctacttacggcgtgtgatctctaatctcctaaccccaaatctctaaagagagagagagaagaagaaagaacagagtagcccccgagacgctttcgttttgacacatcaagtggtccttccatgcagagttcgtgtttcttcctttggtaggacatagaggttctcttttgtttatgcgtgtatcaatcagtgtattgagtttgtttgcgtgtatgtgattacgtgtatcttctctttttgtatttatatgtcatctcgttttcgtaatgcttctacgcttctgtacagttttgctgcaatgataatgaagttatgta

SEQ ID NO: 4461 - DNA, 540 bp, Brassica napus
ctctacaacatttgtggaataattaacaattaactctacgatcttgaaactattagggttgataccatggggttactagatcatctttgggatgataccgtcgctggtcctctgccagagaacggccttggcaagcttcggaaacaccatactttcagtttccggccaagctccgccaatgatcaatcggaggtgaggtcgtacggcggagattcaccggaagaggcagtgaaagtaacacgaagcatcatgataataaaaccaccaggttaccaaagcggttccgctccggtgtcgccggccagttcaactacaccggaggaaagaaaccctttcggtttaggagaaggtcggcatcggacgcgttcgataaggcagcaggatcagggaatggaccaaggaactctcctcctacttacggcgtgtgatctctaatctcctaaccccaaatctctaaagagagagagagagaagaagaaagaacagagtagacgccccgagacgtctttcgtttgacacatcaagtgtccttgcatgcag

SEQ ID NO: 4462 - DNA, 766 bp, Cleome gynandra
agagcaagcgatttctctaacgtgcgccgggaaaactttttccaagttatccttcgccgccgtgttttgctaacctaagccccgtcccatgggcttactcgatcatctctgggacgacaccgtcgctggtccgcggccggagaacggcctcggaaagcttcggaagcaccataccttcagtttccggccaagctccggaaatgatcaaccggagggtgggagtgtgaaatcgtacggtgaggaatcgccggaggaggcggtgaaagtcacgcgcagcatcatgatagtgaagccgccggggtaccagggcgggtcagcaccggtttcgccagccagttcaacaccgccagtgtctcctttctctggagggaaggaatcctttctctttagaagaaggtcgacattggacgcattcgagaaggcaagtgagactggatcaaggggctctcctcctccttaccgcgtgtgacatttaacaacatccgcaaacaaacaagggtcagagggtaatttcattacgtttccgcggttcttttttaaggaataaggaaaaaaagactagactatatgtggaggagttggaaggcgtcgactttggcaccgctttgttgtgggttctgttaggcttgcagtttggtttgtgttagagtcttgtgatggttccttttgtgtttgatgtacttagtgttaagatgaaatctccttattaggcttttggttgatgtaatgtgtatgtgcatatgtaaattttgcctcaataataaga

SEQ ID NO: 4463 - DNA, 1011 bp, Arabidopsis lyrata
ttaaactccatcaagataaagctaaggacacgatcgtaaatacaaaaagatagcgagagatgcggtcacgtgagacgcatttataaccctccgatgaaagccacgtgtcactccgatctaaatatctcgaccttatcgggtcccacacttccaatcctcgaccttatccaccttacgtagacctaagatccaactgccacgtcacacataattcaacggctcagattgacccgatcgcctttaaatcatcgcttccttcatgaaacatggaaactctctacaacaagtttcaaaaaaccccaaaaactttagattcttaacaatttcaaccctatgggcttacttgatcatctctgggatgataccgtcgctggtccacggccagaaaacggccttggcaagcttcgtaaacaccataccttcagtttccgacctagctccggcaatgatcaaccggaagctggaagtgcgagatcgtacggtgaggattcgctaccggaagaggcagtgaaagttacaagaagcatcatgattgttaaaccaccgggttatcaaggcggttcagctccggcttcgccggcttcgccggccggttctactccgccgctatctcctttctctccgccgctgtctccgttctctgcaaacgcaggaggaaaggaaccctttcggtttaggagacggtcgacgtcggatgcgttcgttaaggcagcaggaggatcagagactggaccaaggagctctcctcctacttacggcatgtgatctctaataaaatcatgaaaaagagagaagaacaagaaaacagagtacccttaaccgctgtcgttttgacaacatgaagtggttgtattttgcttttgtaggccaaagaggtgttctcttatgtgtgcgtgtatgagtttgtttgtgtgtttgtttctatatgtaatttcgtcttttcggttatgcttttttgcgtttgtaaatttttgctgcaatgataataaaaacatgtagatgcttaacttc

SEQ ID NO: 4464 - DNA, 745 bp, Brassica napus
atcaacgcagagtacgcgggaatatctttttccaccgcaacatctgtgaaaaaaacataacttgactcgagccatgggcatacttgatcatctctgggatgataccgtcgctggtcctcggccggagaacggcctgggcaagcttcggaaacaccataccttcagtttccggcctagctccggcaatgatcaattggacggtggaaacgtgggatcgtacggtggagattcgccggatgaaggtttgaaagtgacacgcagcatcatgataataaaaccaccaggataccaaggcggttcagctccggtttcgccggccggttcaactccaccgatttctcctttatctgagcaaacgcaaggtcgacttcggacgcgttcgagaaggcagcaggatcagagaatggaccaaggaactctcctcctacttacggcgtgtgatctctaatctctaaccccaaatctttaactagagaaggagaagaagaagaaaaatcagagtaagcgatttcgttttgatacatggaggtggtcgttgcatgcagagttcgtctttattccttttgtaagctaagctaaagagcttctcttttgtttatgcgtgtatgaggttgtttccatgtttgtgattgcgtctcgccgtctctgtttttttagtgtgtgggtatgtgtgccatctcgttttcgctatgctttctacgtgtctgtacatatttactgcaatgataataaacttatgtagttc

SEQ ID NO: 4465 - DNA, 778 bp, Brassica juncea
cgcagcttcacaatgttttcgtctatggtagctttcaggagcctgaggtcgtcaaggtcatgcttgatcgtactcctgaaatcatccctgtaacactccctggctttaagaggtttaggcttaaaggacgtttgtatccatgtgttataccgtgtgaagatggagaagtcaaaggacagttactaatgggattaacggatgaagaacttgagaatgttgatgctgttgagggtaatgaatatgagagagtgacagttggtgttgtacgagaggacaattctgagaagatgactgtgaaaacatacatatggctcaataaagatgatcctgatatcggaggagaatgggatttcgaggaatggaaacgactacacatgaagctattcatagagaaattcaaagaaatcatggaatggaagaggaatcctcaaggaaagggaagggacgacttcaaccatgtcctacgcgatgctccatcggcttgaatgaaatccgtgctaagagtatgttctatgtatcatttttctccagattctgagtataataaaacctggagaagtgatgggtattgtggagataagtgaaaagaataataatgacatatgttattttgtgcattgtaatatgatatataagccttctggagattttggcatttatcttgtgtatggtttggttcggttgggttcatgccaatgcttatggcttctctttctaagtagttaattacagagagtagcagatcactgaactaatctgcttaaagaataaaatctga

SEQ ID NO: 4466 - DNA, 758 bp, Raphanus sativus
  misc_feature (587)..(587): n is a, c, g, or t
aaaaaaaaagaaaaatgagtggctccggtacgcagcttcacaatgttttcgtctatggtagctttcaggagcctgaggtcgtcaaggtcatgcttgatcgtactcctgaaatcatctctgtaacactccctggctttaagaggtttaggcttaaaggacgtcagtatccatgtgttataccgtctgaagatggagaagttcatggaaagttactaatgggattaacagatgaagaacttgagaatttagatactgttgagggtaatgaatatgagagagtgacagttggtgtcgtacgagaggacaattctgagaagatgactgtgaaaacatatatatggatcaataaagatgatcctgatatcggaggagaatgggattttgaggaatggaaacgcctacacatgaaggaattcataaagacgttcaaagaaatcatggaatggaagaggaatcctcaaggaaagggaagggacgagttcaacaatgccctacgcgatgctccttcggtttgaatgaaatctgtgctaagagtatgttctatgtatcatttttctccagattgcgagtataataaaacctagagnctgatagtattgtggagatcagtgaaaaggatatagtgccatatgttatcttgtggattgtattattgttcttatatgggattttggtatctatattttgtatggtttgcttgatgctaagaccatccacaatggtggattgctcttggaatccttaaaattattatatta

SEQ ID NO: 4467 - DNA, 797 bp, Raphanus sativus
aagcaaataaagcagaaaaaaaaaaactgaagagaaaataaaaatgagtggctcgggtgcgcagcttcacaatgttttcgtctatggtagctttcaggagcctgaggtcgccaaggtcatgcttgatcgtactcctgaaatcatctctgtaacactccctggctttaagaggtttaggcttaaaggacgtttgtatccatgtgttataccgtctgaagatggagaagttcatggaaagttactaatgggattaacggatgaagaacttgggcatttagatactgttgagggtaatgaatatgagagagtgacagttggtgtcgtacgagaggacaactctgagaagatgactgtcaaaacatatatatggatcaataaagatgatcctgatattggaggagaatgggattttgaggaatggaaacgactacacatgaaggaattcataaagacgttcaaagaaatcatggaatggaagaggaatcctcaaggaaagggaagggacgagttcagcaaggccctacgcgatgctccttcggtttgaatgaaatctgtgttaagagtatgttctatgtatcatttttctccagattccgagtataataaaacctagagactgatagtatcgtggagatcagtgaaaaggatatagtgccatatgttatcttgtggattttgtattattgtgcttatatgggattttggtatctatattttgtatggtttgcttgatgctaatgcttatgcctttgtgacatttgagaagtcatgtgaatttgataagtcatgtgaagtca

SEQ ID NO: 4468 - DNA, 737 bp, Raphanus sativus
agcaaataaagagaaaaaaaaacctgagtaaaaaaagaaaaatgagtggctccggtgcgcagcttcacaatgttttcgtctatggtagctttcaggagtctgaggtcgtcaaggtcatgcttaatcgtactcctgaaatcatctctgtaacactccctggctttaagaggtttaggctcaaaggacgcttgtatccatgtgttataccgtctgaagatggagaagttcatggaaagttactaatgggattaacggatgaagaacttgagaatttagatgctgctgagggtaatcaatatgagagagtgacagttggtgttgtacgagaggacaattctgagaagatgactgtgaaaacatatatatggatcaataaagatgatcctgatatcggaggagaatgggattttgaggaatggaaacgactacacatgaaggaattcatagagacgttcaaagaaatcatggaatggaagaagaatcctcaaggaaaaggaagggacgagttcaacaatgccctacgcaatgctccttcggtttgaatgaaatctgtgttaaagagtatttttctatgtatcatttttctccagattccgagtataataaaacctagagactgatagtattgtggagatcagtgaaaaggatatagtgccatatgttattttgtggattgtattattttgtgcttatatgggattttggtatctatattttgtatggtttgtttgatgcta

SEQ ID NO: 4469 - DNA, 792 bp, Raphanus sativus
aacatttcataaagaaacagcagaagcaaataaagcaaaaaaaaaaaagactgaagagagaagaaaaatgagtggctccggtgcgcagcttcacaatgttttcgtctatggtagctttcaggagcctgaggtcgtcaaggtcatgcttgatcgtactcctgaaaccatctttgcaacactccctggctttaagaggtttaggcttaatggacgtttgtatccatgtgttataccgtctgaagatggagaagttcatggaaagttattaatgggattaacggatgaagaacttgagaatttagatgctgtcgagggtaatgaatatgagagggtgacagttggtgttgtaccagaggacaattttgagaagatgactgtggaaacatatatatggatcaataaagatgatcctgatatcggaggagaatgggattttgaggaatggaaacgactacacatgaaggaattcatagagacgttcaaaaaaatcatggaatggaagaggaatcctcaaggaaagggaagggacgtcttcaacaatgccctacgcgatgctccttcggtttgaatgaaatctgtgttaggagtatgttctacttctatgtatcatttttctccagattccgagtataataaaacctagagactgatagtattgtggagatcagtgaaaaggatatagtgccatttgttatcttgtagattgtattattttgtgcttatatgggattttggtatctatagtttgtatggtttgcttgatgctaatgcttatgcctttgtttaagtttg

SEQ ID NO: 4470 - DNA, 712 bp, Brassica juncea
cgggacggaaggagttctatatgaaactagaggagaagatccaagctaaggaagtagagaagacaactttgcaggaaaaagaaaaaaaatgagtggctccggtgcgcagcttcacaatgttttcgtctatggtagctttcaggaacctgaggtcgtcaaggtcatgcttgatcgtactcctgagatcatctctgtaacactccctggctttaagaggtttaggcttgaaggacgtttatatccatgtgctatagcgtctgaagatggagaaatccatggaaagctaataatgggattaacggatgaagaacttgagaatgtagatgctgtcgagggtaatgattatgagagagtgacagttgatgttgtaagagaggacaattctgagaagatgactgtgtacacatatatatggatcaataaggatgatcctggtatcggaggagaatgggatttcgaggcatggaaacgactacacatgtaagtaaattcatagagatgttcaaagaaatcatggaatggaagaggaatcctcaaggaaaggtaagggacgacttcaaggatatcctacgcgatgatccatccgcttgaatgaaatctctgttaagagtctgttctatgtaccatttttctccagattccgagtataataaaacctagagagtgataggtattgtggagataagtgaaaagaataataatgtcatgttta

SEQ ID NO: 4471 - DNA, 2035 bp, Arabidopsis thaliana
ctctcctcttcacacctctctctcgccgacgacgctacaaccatggcgtctctcgctctctccggctcctgctctctcgctttccctctcaaatctcgatctctctctctccctcgtcctccttcttcctctctcaatttgacgaaacctctccgatctctcgattctcgcttctccttactcaaatctccacttcccgtctctttacgccggagatcatcaactctcgttaaagcctcttccaccgtcgcttcagcttcctcttctccaactcctcctttggttccagctccggttccatggcaaggagctgccattaagcctcttctcgcttcgatcgctactggtttgattctatggttcgttccagtccccgaaggtgtcactcgcaacgcgtggcaattactcgcgatcttcctcgccaccatcgtcgggatcatcactcagccgcttcctctcggtgctgttgctctaatgggattaggagcttccgttctcaccaaaaccctaacgttcgccgccgcgttctccgctttcggagatccaatcccgtggctcatcgctcttgccttcttcttcgctcgcggtttcatcaaaaccggtctcggtaaccgtgtagcttaccagttcgttagactcttcggtagctcctcccttggtctcggttacagtctcgtcttcagtgaagctcttttagctccggcgattccttctgtctcggctcgtgccggtggaatctttctcccgttggtgaaatctctctgtgttgcttgtgggagtaacgttggggatggaacagagcaccgtcttggctcgtggttgatgcttacttgtttccagacttctgtgatctcttcttctatgttcttgacggctatggctgcgaatcctttgagtgctaatttggcgtttaacacgattaagcagacgattggatggactgattgggctaaagctgcgattgtaccaggacttgtgtctttgattgttgttccgtttcttttgtatctcatctatcctcctacggtgaagagcagtcctgatgctcctaagctggctcaggaaaagcttgacaagatgggacctatgtctaagaacgaattgattatggctgccactttattcctcacggttggtctctggatctttggagctaagttgggtgtagatgctgtgactgcagccattcttggattatcagtccttcttgtgacaggtgttgtgacatggaaagagtgcttagctgagtcggtcgcatgggacacactcacctggttcgctgctctcattgcgatggctggttatcttaacaaatatggtctcattgagtggttcagccagaccgtagtcaagtttgtgggaggattgggtttgtcatggcagctatcttttggaatcctcgtcctcttgtatttctacactcactacttctttgctagtggagctgcccacattggtgctatgttcactgcctttttatcggtttcaaccgctctaggcactccaccttactttgcagccttggttcttgcgttcctttccaacctgatgggaggattgacccattatggtatcgggtctgcgcctatcttctacggagctaactacgtgccgctggctaaatggtggggctatggattcctgatttcaatagtcaacattctcatctggcttggtgtaggtggtgcctggtggaagttcattggcttgtggtgaggaccaccatacaccaatcttcccattcttttccttacttatatatataatctcttagaacggctttgagattcagatttgagaaggattgaaatcagggttataaggattgagcagagtttttctgcaatttttattctcactcacacacattttgaagtgtaagcaatcttaacttgcgtcaattttgtttgatttctaactttactgtttcaaagtgagaccaccactttacttgatagttactcgacttccataaacgtgttagttgagagattaatgtctattagtctatgaatcgctggttaaagtttagtgg

SEQ ID NO: 4472 - DNA, 2008 bp, Arabidopsis thaliana
ctctcctcttcacacctctctctcgccgacgacgctacaaccatggcgtctctcgctctctccggctcctgctctctcgctttccctctcaaatctcgatctctctctctccctcgtcctccttcttcctctctcaatttgacgaaacctctccgatctctcgattctcgcttctccttactcaaatctccacttcccgtctctttacgccggagatcatcaactctcgttaaagcctcttccaccgtcgcttcagcttcctcttctccaactcctcctttggttccagctccggttccatggcaaggagctgccattaagcctcttctcgcttcgatcgctactggtttgattctatggttcgttccagtccccgaaggtgtcactcgcaacgcgtggcaattactcgcgatcttcctcgccaccatcgtcgggatcatcactcagccgcttcctctcggtgctgttgctctaatgggattaggagcttccgttctcaccaaaaccctaacgttcgccgccgcgttctccgctttcggagatccaatcccgtggctcatcgctcttgccttcttcttcgctcgcggtttcatcaaaaccggtctcggtaaccgtgtagcttaccagttcgttagactcttcggtagctcctcccttggtctcggttacagtctcgtcttcagtgaagctcttttagctccggcgattccttctgtctcggctcgtgccggtggaatctttctcccgttggtgaaatctctctgtgttgcttgtgggagtaacgttggggatggaacagagcaccgtcttggctcgtggttgatgcttacttgtttccagacttctgtgatctcttcttctatgttcttgacggctatggctgcgaatcctttgagtgctaatttggcgtttaacacgattaagcagacgattggatggactgattgggctaaagctgcgattgtaccaggacttgtgtctttgattgttgttccgtttcttttgtatctcatctatcctcctacggtgaagagcagtcctgatgctcctaagctggctcaggaaaagcttgacaagatgggacctatgtctaagaacgaattgattatggctgccactttattcctcacggttggtctctggatctttggagctaagttgggtgtagatgctgtgactgcagccattcttggattatcagtccttcttgtgacaggtgttgtgacatggaaagagtgcttagctgagtcggtcgcatgggacacactcacctggttcgctgctctcattgcgatggctggttatcttaacaaatatggtctcattgagtggttcagccagaccgtagtcaagtttgtgggaggattgggtttgtcatggcagctatcttttggaatcctcgtcctcttgtatttctacactcactacttctttgctagtggagctgcccacattggtgctatgttcactgcctttttatcggtttcaaccgctctaggcactccaccttactttgcagccttggttcttgcgttcctttccaacctgatgggaggattgacccattatggtatcgggtctgcgcctatcttctacggagctaactacgtgccgctggctaaatggtggggctatggattcctgatttcaatagtcaacattctcatctggcttggtgtaggtggtgcctggtggaagttcattggcttgtggtgaggaccaccatacaccaatcttcccattcttttccttacttatatatataatctcttagaacggctttgagattcagatttgagaaggattgaaatcagggttataaggattgagcagagtttttctgcaatttttattctcactcacacacattttgaagtgtaagcaatcttaacttgcgtcaattttgtttgatttctaactttactgtttcaaagtgagaccaccactttacttgatagttactcgacttccataaacgtgttagttgagagattaatgtctattagtc

SEQ ID NO: 4473 - DNA, 1947 bp, Arabidopsis lyrata
cttcacttccctctctcgccgacgacgctacaacaatggcgtctctcgctctctccggctcctgctctctcgctttccctctcaaatctcgatctctctctctccctcgtcctccttcttcctctttcaatttgacgaaacctctccgatctctcgattctcgcttctccttactcaaatctccacttcccgccgcttctcttaaccggagatcatcaactctcgttaaagcctcttccgccgctgcttctccgtctcctcccgttgctccagctcccgttccatggcaaggagctgccattaagcctcttatcgcatcgatcgctactggtttgattctatggttcgttcctgtccccgaaggtgtcactcgcaacgcgtggcaattactcgcgatcttcctcgccaccatcgtcgggatcatcactcagccgcttcctctcggcgctgttgctctattgggattaggagcttccgttctcaccaaaaccctaacgttcaccgccgcgttctccgctttcggagatccaatcccatggctcatcgctctcgccttcttcttcgctcgtggtttcatcaaaaccggtctcggtaaccgtgtagcttaccagttcgttagactcttcggtagctcctcgcttgggctgggttacagtctcgtcttcagtgaagctctcttagctccggcgattccttctgtctcggctcgtgccggtggaatctttctcccgttggttaaatctctctgtgttgcttgtggtagtaatgttggggatggaactgagcaccgtcttggctcgtggttgatgctcacttgtttccagacttctgtgatctcttcttctatgttcttgacggctatggctgccaatcctttgagtgctaatctggcgtttaacacgatcaagcagacgattggatggactgattgggctaaagctgcgattgtaccaggacttgtgtcgttgattgttgttccgtttcttttgtatcttatctatcctcctacggtgaagagcagtcctgatgctcccaagctggctcaggaaaagcttgacaagatgggacctatgtctaagaacgagttgattatggccgccactttgttcctcacggttggtctctggatttttggagctaagttgagtgtagatgctgtgactgcagccattcttggattatcagtcctccttgtgacaggtgttgtgacatggaaagagtgcttagctgagtcggtcgcatgggacacactcacctggttcgctgctctcattgcgatggctggttatcttaacaaatatggtctcattgagtggttcagccagaccgtagtcaagtttgtgggaggattgggtttgtcatggcagctatcgtttggaatcctcgtcctcttgtatttctacactcactacttctttgccagtggagccgcccacattggagctatgttcactgcctttttgtcggtctcaaccgctctaggcactccaccttactttgcagccttagtccttgcgttcttatccaacctgatgggaggattgactcattatggtatcggatctgcgcctatcttctacggggctaactatgtgccgctggctaaatggtggggctatggattcctgatttcaatagtcaacattcttatctggcttggtgtaggtggtgcctggtggaagttcattggtttgtggtgaggaccacaatacaccagtattcccattcttttccttatatatataatctcttagaacggctttgagattcagatttgagaaggattaaaatcagggttttaaggattgagcagagtttttctgcaatttttattctcactctcacacatattttgaggtgtaagcaaatcttaacttgcatcaattttgtttgatttctaacttgacttttttgttcaaagtgagaccaccactttactcgatagtt

SEQ ID NO: 4474 - DNA, 1827 bp, Cleome gynandra
tcctcacagacgctgcaacaatggcgtctcttgcactctctggttccctctcccttgcatttcataccaaatcccgatctctcgccctccctccactcaagagttctctctctctcaatccgccgaaaagcctcaaatctctagtttctaaaactcccaatccgatctccctcaaatcccctatcgcgaaaaccccatttcaccggagatactccgtcgtttccgcctcctccgccgcatctccgccttctccggcggctcattctccggcgccatggcaaggggccgctatcaagcctctcatggcctcgatcgccaccggagtgatcctatggttcgtccctgtcccagacggagtctctcgcagcgcgtggcagctactagctatctttctcgccacgatcgttggaatcatcacgcaacctctacccctcggtgctgtcgcgcttatgggacttggggcctctgtcctcaccaaaaccctaactttctccgctgccttctccgccttcggagacccgattccgtggctcattgctctggccttcttctttgctcgggggttcataaaaacagggctcgggaaccgaatcgcgtaccaattcgtccggttatttggaagttcctctctgggtcttggttacagtctcgtctttagcgaggctctgttggctccggcgattccctccgtctcggctcgtgcaggtgggatctttctccctctagtgaaatcactatgcgtcgcttgcggtagcaacgccggagacgggaccgagcataagctcggggcgtggttgatgctcacgtgttttcagacttcggtgatatcgtcgtcgatgtttctgacggcgatggctgcgaaccctttgagtgcaaatttggcttataatacgattaagcagacgattgggtggacggattgggcgaaggctgctatagtccccgggatcgtgtcgttgatcgttgtgccgttgattttgtatattatctatcctcctacggtgaagagtagtcctgatgctcccaagttggctaaggagaagctggagaagatgggacccatgtcgaagaacgagcttataatgtctgctactctgcttctaacggttggcctctgggtctttggaggcaagttgaatgtggatgctgtaactgcggcgattcttggactgtcgatccttttggtgactggggttgtaacatggaaagagtgcttagctgaggcggttgcttgggatacactcacttggtttgccgctctcattgcaatggctggctatcttaacaagtacggtctcattgaatggttcagccaaaccgttgttaagtttgtgggtgggctcgggttgtcgtggcaactatcctttggaatccttgtcctcctctacttctactcccattacttctttgctagtggagcagcccacataggtgcaatgttcacagccttcttatctgttgcgtctgccctaggcactccaccatactttggagccatggttcttgcattcctctcaaaccttatgggtggcctcacccactatggtattggatcggctcctgtcttctacggtgctaactacgtacctttggccaaatggtggggctatggattcctcatttccgttgtcaacattctcatttggctcggtgttggtggtgcatggtggaagtttattggcttgtggtgaatggaatcgattcacggtctcgtattctggtagctctattctagtttgaagcctattattttaggcttatcttttgttttctcttcttttcgtcggatgggtttgaatcttaggttgatatgattgcgaatcgtgt

SEQ ID NO: 4475 - DNA, 1919 bp, Cleome gynandra
gagaatcctaaacctatcactgcctctgaacgccaaaatctctcgctctccaccgtacgatcttcatcctacggtccaccttctctcctcctccacttcctccccagtcgctgctacaatggcgtccctccctctctccgcctccttctccctctcatttcccgccaaatcccgatcctctgctctccctccattgaagagatatctctctctcaatccttcgaaacccctcagatccctcgattccaaaatctccaatcctgtcgccctcaaattccttaccaaatcccctgtttatcggagatccagcgtcgtctccgcatccaccgccgcatctcagccgtctccggcagttcccgcaccggtgccatggaaaggggccgctatgaagcccctaatcgcctcgattgctaccggagtgatcctctggttcgtccccgtccccaatggtgtctcccgcagcgcgtggcagcttctcgccattttcctcgcgacgatcgtcggaatcatcacccaacccctccctctcggtgcggtcgcgctaatgggtctaggagcatccgtactcacaaaaacactaaccttctccgccgccttctccgccttcggcgacccgatcccatggctcatcgctctcgccttcttcttcgctcgtgggttcatcaaaacaggtcttgggaaccgcatcgcataccaattcgtgcgattgttcgggagctcgtctctcgggctcggttacagtctcgtcttcagcgaggctctcttggctccggcgattccctccgtttccgctcgtgccggaggaatctttcttcctctggtgaaatcactatgcgtcgcttgcggtagcaacgcaggggacgggaccgagcaccgcctcggagcgtggctaatgcttacatgtttccagacatcagtgatttcgtcttctatgtttctgacagcaatggcggcgaatccattgagtgcaaacttggcgtataatacgattaagcagacaattgggtggacggattgggcgaaggccgctatcgtccctgggatcgcgtcgttgatcgttgtaccattgcttttgtatattatatatccacctacagtgaaaagtagtcctgatgctcccaagttggctaaggagaagctggagaagatgggaccaatgtcaaagaacgagcttataatgtctgctactctgcttctcacggttggcttatgggtctttggaggcaagttgaatgtggatgccgtgactgcggccattcttggattgtcgattctcctggtgacgggagttgtgacatggaaagagtgtttagctgaggcggttgcgtgggatacccttacttggtttgcggctctcatcgcgatggctggctatcttaacaaatatggtctcattgattggttcagccaaacagttgtcaagttcgtgggcggacttggattgtcgtggcaactatcctttggaatcctagtccttctctacttctactctcactacttcttcgcaagtggagcagcccacattggtgcaatgttcacggccttcttatcggttgcatctgctctaggcactcctccgtactttggagccatggttttggcattcctctccaacctcatgggaggcctcacccactacggtatcggatccgctccggtcttctacggtgcaaactacgtaccattggctaaatggtggggctacggctttgtcatttccgtcgttaacattctgatttggctcggcgtcggtggcgtctggtggaagttcatcggcttgtggtgaatcaaatcaattctctttactctttgatatacctttactcccctttccttcctttttcccttcttttcgctttgatataaccttaggttgatcagattctgattcttgattcattataatagagaattattta

SEQ ID NO: 4476 - DNA, 2358 bp, Populus trichocarpa
cggtggaccaggagatctcagacggacacttcaacttcaggccgatactaacgaagctcaccccccagaactgaacttctcgttccttcaaaaccactgtactgtacagaagggaagactgaaaacccaattcacttccctttctctctcgaaagccatagatacgcaaaatggcgtcgtttgctctcacatcatcttctctttctttcagttccctcccttgtctcaaatcccgctctctctcccacctaaggtccacctcacaaaaccccctccctcctcgtccaaatctccctaaactctctgctgtctctcccttacttccaaaattatccaaatctagcgtcacatcgacgacgcggagaatctctaacttcgcagtaaaagcctcgtcagcatcatccgcacctacatcaattacaccagcctcaccgccatggcaaggagctgcaatgaaaccgttactagcatcaatcgcgataggtgtcattctctggttcgttccggtcccttctggagttacgaaaccagcctggcaactactcgcaatttttcttgctacgatagtcggaatcatcacgcaacctttaccgctcggcgcggtagctttgatgggtttaggcgcttcagttctaacaaaaaccctccctttctccgcggctttttccgcatttggtgatccaatcccttggttaatcgcactcgcgttctttttcgcgcgtggatttatcaaaaccgggcttggtaaccgaattgcgtatcaattcgtgtctctgttcgggtcttcttcgttagggttaggttatagtcttgtttttagtgaagctttattagcaccggcgattccttctgtttctgcacgagcaggagggatttttttgccgttggtgaagtcgctttgtgttgcttgtggaagcaatgttggtgatggaacagagcataggcttggttcatggttaatgttaacttgtttccagacatcagtgatttcgtcttccatgtttttgacagctatggctgcgaaccctttgagtgctactttgacattcaatacgattcagcagactattgggtggacggactgggctaaggctgcaattgtgcctgggttgatttcattgattgttgttccgttgattttgtatttaatttatccgccaaccgtgaagtccagtcctgatgctcctaaattggctagggagaagttggagaagatgggacccatgactactaatgagattattatggctggcactctgtttctcacggtgggactttggattttcggagggatgctgaatgtggatgctgttactgctgctattcttggattgtctgtcctccttatcactggtgtagtgacatggaaggagtgcttagccgaatctgttgcctgggataccctgacatggtttgcggccctcattgccatggctgggtatctcaacaaatatggtctcatctcctggttcagccaaactgtagttaagttcgttggtggacttggtctatcgtggcagctatcttttggcattttggtccttctctacttctactcccactacttctttgccagtggagcagctcacattggtgccatgtttacagcattcctgtctgttgccagtgctctgggtactcctccatattttggagccatggttcttgccttcctttctaacctcatgggcggccttacacactatggaattggatccgcacctattttctatggtgccaactatgtacctctggccaaatggtggggctatgggttcctcatatctgttgtcaacattattatctggcttggggttggaggagtttggtggaaggccattggcttgtggtagggagctgatcatgaaaattcgccgacccaaaacttgtggtatcccaactcttattagccctcagaagcgactttcacatcttgatttactgtctggtgaaaggcttttagtttttgttctgaatctttctcatagaaataatcttttggtggccttggtagagacctctgttagaaagatggtatacgcttagtcttattatagcagaaattataacctgtacctgaaattttggcaaggcgtaacgactgcctggaattcattacagagcagtcctgatgcctgaatatcttctctccgtctctatacatagtttcttggtggcatgaggaagggatgatcatggagacgtgctcgttcgcttggtaatttacctttcgtttttcttttttttgggcaaagtggttggaattttaccaagattatgattgccgtggaggtgttaaatctcattacaacctttttatttcccataaatgtgttggttttccataattgcatgtta

SEQ ID NO: 4477 - DNA, 2330 bp, Populus trichocarpa
acggacacttcaacttcaggccgatactaacgaagttcaccccccagaactgaacttctcgttccttcaaaaccactgtactgtacagaagggaagactgaaaacccaattcacttccctttctctctcgaaagccatagatacgcaaaatggcgtcgtttgctctcacatcatcttctctttctttcagttccctcccttgtctcaaatcccgctctctctcccacctaaggtccacctcacaaaaccccctccctcctcgtccaaatctccctaaactctctgctgtctctcccttacttccaaaattatccaaatctagcgtcacatcgacgacgcggagaatctctaacttcgcagtaaaagcctcgtcagcatcatccgcacctacatcaattacaccagcctcaccgccatggcaaggagctgcaatgaaaccgttactagcatcaatcgcgataggtgtcattctctggttcgttccggtcccttctggagttacgaaaccagcctggcaactactcgcaatttttcttgctacgatagtcggaatcatcacgcaacctttaccgctcggcgcggtagctttgatgggtttaggcgcttcagttctaacaaaaaccctccctttctccgcggctttctccgcatttggtgatccaatcccttggttaatcgcactcgcgttctttttcgcgcgtggttttatcaaaaccgggcttggtaaccgaattgcgtatcaattcgtgtctctgttcgggtcttcttcgttagggttaggttatagtcttgtttttagtgaagctttattagcaccggcgattccttctgtttctgcacgagcaggagggatttttttgccgttggtgaagtcgctttgtgttgcttgtggaagcaatgttggtgatggaacagagcataggcttggttcatggttaatgttaacttgtttccagacatcagtgatttcgtcttccatgtttttgacagctatggctgcgaaccctttgagtgctactttgacattcaatacgattcagcagactattgggtggacggactgggctaaggctgcaattgtgcctgggttgatttcattgattgttgttccgttgattttgtatttaatttatccgccaaccgtgaagtccagtcctgatgctcctaaattggctagggagaagttggagaagatgggacccatgactactaatgagattattatggctggcactctgtttctcacggtgggactttggattttcggagggatgctgaatgtggatgctgttactgctgctattcttggattgtctgtcctccttatcactggtgtagtgacatggaaggagtgcttagccgaatctgttgcctgggataccctgacatggtttgcggccctcattgccatggctgggtatctcaacaaatatggtctcatctcctggttcagccaaactgtagttaagttcgttggtggacttggtctatcgtggcagctatcttttggcattttggtccttctctacttctactcccactacttctttgccagtggagcagctcacattggtgccatgtttacagcattcctgtctgttgccagtgctctgggtactcctccatattttggagccatggttcttgccttcctttctaacctcatgggcggccttacacactatggaattggatccgcacctattttctatggtgccaactatgtacctctggccaaatggtggggctatgggttcctcatatctgttgtcaacattattatctggcttggggttggaggagtttggtggaaggccattggcttgtggtagggagctgatcatgaaaattcgccgacccaaaacttgtggtatcccaactcttattagccctcagaagcgactttcacatcttgatttactgtctggtgaaaggcttttagtttttgttctgaatctttctcatagaaataatcttttggtggccttggtagagacctctgttagaaagatggtatacgcttagtcttattatagcagaaattataacctgtacctgaaattttggcaaggcgtaacgactgcctggaattcattacagagcagtcctgatgcctgaatatcttctctccgtctctatacatagtttcttggtggcatgaggaagggatgatcatggagacgtgctcgttcgcttggtaatttaccttctttcgtttttctttttttttgggcaaagtggttggaattttacttcaagattatgattgccgtggaggtgttaaatcccattacaacctttttatttcccataaatgtgttggttttcca

SEQ ID NO: 4478 - DNA, 2837 bp, Populus trichocarpa
aatattggttataagccactattgctgacctgaagccttctcaaccaattatagtcaaccacgtgtactgcacagtcacttcacggtacacaattaccaaaaaggccacgttccttcagaaacccaatccactcacaatctgccacgttaacaaggtgccctcaattccaccggcgcatgctagcaactagccttgccacaaataaagacaacatgggccggtgaatcggaagatcttagacggacacttcaactccagggcgaaactaacgaagctcaccccactggcaaaaagaaagaaagaaaaaaaagcccgtatattccatccatcgtatccaccgtttgatcaaaaaccaacagctcagatcctcccctccttacttcccatataaaacaacgccaatcaatcatctctcaaaacttccttttccttcccttcaaaaccactgtgcagtgtacagaacagaagtgaagactgaaaacccaaacccccccccctcctcgaacgccataccccaaaatggcgtcgtttgctctgacatcatcttctctttccttcaacaactccctcccttgtctcaaatcccgctctctctcacacctgagatccaccgcaccacatcccctccctttccgtccaaatctcccaaaactctctactgtctctcccttactcccaagattctccaaatctaaaattacaacatccacccggaaaatctctaacttctcagtaaaagcatcagcatctgcagcatcaccgtcacccgcaccaacatcaattacacctgcctcaccgccatggcaaggagcagccatgaaacctttactagcatccatcgcgacaggtgtcattctctggttcgttcctgttcccgcgggagttacgaaaccagcatggcagctgctcgcaatttttcttgctacaatagtcggaatcatcacgcaacctttaccgcttggagcggtagctttgatgggtttaggcgcttcagttctaacaaaaaccctcactttctccgccgcgttttccgcattcggtgatccaatcccttggttaattgcactcgctttcttcttcgcgcgtggatttatcaaaaccggacttggtaaccgaattgcgtatcaatttgtgtctctgtttggatcttcttcgttagggttaggttacagtcttgtttttagtgaagctttactagcgccggcgattccttctgtttctgcacgagcaggagggatatttttgccgctagtgaagtcactctgtgttgcttgtggtagtaatgcgggtgatgggacggagcataagcttggttcgtggttaatgttaacttgtttccaaacatcagtgatttcgtcttccatgtttttgacagctatggctgcgaatcctctgagtgctactttgacattaaatacgattaaacaaacaattgggtggacggattgggccaaggctgcgattgtgcctggattggtttcgttgattgttgttccgttgattttgtatttcatttatccgccaactgtcaagactagtcctgatgcacctaaattggctagggagaagttggagaagatgggacccatgtctactaatgaaattattatggctggcactctgtttctcacggtgggactctggatatttggtgggatgctgaatgtggatgctgttactgctgctattcttggattgtctgtccttcttgtcactggcgtagtgacatggaaggagtgcttagctgaagcagttgcctgggataccttgacatggtttgctgccctcattgccatggctgggtatcttaacaaatatggtctcatctcctggttcagccaaactgtagttaagtttgttggtggactcggtttatcgtggcagctatcttttggaattttggttcttctctacttctactcccactacttctttgccagtggagcagctcacatcggtgccatgtttacagcattcctgtctgttgccagtgctctaggtactcctccattatttggagccatggtgctcgccttcttttccaacctcatgggcggccttacacactatggaatcggatctgcacctgttttctatggtgccaactatgtacctctggccaaatggtggggctatgggttcctcatatctgttgtcaacataattatctggcttggggttggaggggtttggtggaagttcattggcttgtggtagaggggtgatcatggaaatccgatgacccaagatttagcaatatccccggttcttattcaccgtcagatgatattttcacatcttgatttattgtctgatgagagaggttgttgatttttgtttctaattcttttccttggaaataatctttcggtggccttggtagagacctcggttagaaaggtggtatacgcatggtcttattagagcagaaattagaacttgtaccaggaattttggcacggcgtagcaactgctgcaattcattacatggaaaaatctgacgcctgaaagtcttttttctgtcgctatagtttcttggtggcatgaggacataccctttttcttggaaatttaccttcttttatatttcgtcaagtggctgggaatttacattaagattcgtgatttccgcggaggtgttgaatccattacaacgttgttccctgaggaggtattggttttttcataatcgcgttccgttgatgtccatgacttggacagattcagatgtattctggtaatttattgggatttcccgtacaatgtttaaatcgtcaattgctcaacatgtctggttgctgaccgttgttccatcaccagatcaaagtatcatatt

SEQ ID NO: 4479 - DNA, 2358 bp, Populus trichocarpa
agacggacacttcaactccagggcgaaactaacgaagctcaccccactggcaaaaagaaagaaagaaaaaaaagcccgtatattccatccatcgtatccaccgtttgatcaaaaaccaacagctcagatcctcccctccttacttcccatataaaacaacgccaatcaatcatctctcaaaacttccttttccttcccttcaaaaccactgtgcagtgtacagaacagaagtgaagactgaaaacccaacccccccccccctcctcgaacgccataccccaaaatggcgtcgtttgctctgacatcatcttctctttccttcaacaactccctcccttgtctcaaatcccgctctctctcacacctgagatccaccgcaccacatcccctccctttccgtccaaatctcccaaaactctctactgtctctcccttactcccaagattctccaaatctaaaatcacaacatccacccggaaaatctctaacttctcagtaaaagcatcagcatctgcagcatcaccgtcacccgcaccaacatcaattacacctgcctcaccgccatggcaaggagcagccatgaaacctttactagcatccatcgcgacaggtgtcattctctggttcgttcctgttcccgcgggagttacgaaaccagcatggcagctgctcgcaatttttcttgctacaatagtcggaatcatcacgcaacctttaccgcttggagcggtagctttgatgggtttaggcgcttcagttctaacaaaaaccctcactttctccgccgcgttttccgcattcggtgatccaatcccttggttaattgcactcgctttcttcttcgcgcgtggatttatcaaaaccggacttggtaaccgaattgcgtatcaatttgtgtctctgtttggatcttcttcgttagggttaggttacagtcttgtttttagtgaagctttactagcgccggcgattccttctgtttctgcacgagcaggagggatatttttgccgctagtgaagtcactctgtgttgcttgtggtagtaatgcgggtgatgggacggagcataagcttggttcgtggttaatgttaacttgtttccaaacatcagtgatttcgtcttccatgtttttgacagctatggctgcgaatcctctgagtgctactttgacattaaatacgattaaacaaacaattgggtggacggattgggccaaggctgcgattgtgcctggattggtttcgttgattgttgttccgttgattttgtatttcatttatccgccaactgtcaagactagtcctgatgcacctaaattggctagggagaagttggagaagatgggacccatgtctactaatgaaattattatggctggcactctgtttctcacggtgggactctggatttttggtgggatgctgaatgtggatgctgttactgctgctattcttggattgtctgtccttcttgtcactggcgtagtgacatggaaggagtgcttagctgaagcagttgcctgggataccttgacatggtttgctgccctcattgccatggctgggtatcttaacaaatatggtctcatctcctggttcagccaaactgtagttaagtttgttggtggactcggtttatcgtggcagctatcttttggaattttggttcttctctacttctactcccactacttctttgccagtggagcagctcacatcggtgccatgtttacagcattcctgtctgttgccagtgctctaggtactcctccattatttggagccatggtgctcgccttcttttccaacctcatgggcggccttacacactatggaatcggatctgcacctgttttctatggtgccaactatgtacctctggccaaatggtggggctatgggttcctcatatctgttgtcaacataattatctggcttggggttggaggggtttggtggaagttcattggcttgtggtagaggggtgatcatggaaatccgatgacccaagatttagcaatatccccggttcttattcaccgtcagatgatattttcacatcttgatttattgtctgatgagagaggttgttgatttttgtttctaattcttttccttggaaataatctttcggtggccttggtagagacctcggttagaaaggtggtatacgcatggtcttattagagcagaaattagaacttgtaccaggaattttggcacggcgtagcaactgctgcaattcattacatagaaaaatctgacgcctgaaagtcttttttctgtcgctatagtttcttggtggcatgaggacataccctttttcttggaaatttaccttcttttatatttcgtca

SEQ ID NO: 4480 - DNA, 2392 bp, Ricinus communis
tttctgctttcttctcggcaaacacactcactggaaaacctctctgctcttcacgctcccaaaacgccaccaaaaatggcgtcgctggctctcacatcatgctctctctccttcaattctctcccatctctcaaatcccgctctctctctcgcctcagatccactccagttccaaatcgctttccttccctccctaaactctcctccgcttccacaagtcctttccttccaaaactcgctaaatcaaatcccacaatttttcccaagcagagaaactctaactttaccgtcaaatcgtccacgtcagcagcaccagcagcatctgcacccgccccttcacagccatggcaaggcgcatctataaaaccattacttgcgtcaatagcaacaggtgtgattatctggttcgttccagtccctacaggggttacaaaaccagcctggcaactactcgccatatttctcgccacaattgttggcatcatcacgcaaccgttaccactcggcgccgtcgccttaatgggattaggcgcttccgtactaactaaaaccctaactttctccgccgcattttccgcttttggcgatccaatcccgtggttgatcgctctcgcattcttttttgcacgtggattcattaaaacaggacttggaaatagaattgcctatcaattcgtgaaactgtttggatcatcttcgttgggtttaggttatagtcttgtatttagtgaagcattactagcacctgcaattccgtcagtttcagctagagctggagggatatttttgccattagtaaaatctttatgtgttgcatgcggtagtaatgcaggtgatggtactgaacataagcttggatcatggttaatgttaacctgcttccagacatcagtgatttcttctgctatgttcttaactgctatggcagctaatcctttgagtgctaatctgacatttaataccattaagcaaacccttggttggactgattgggctaaggctgctattgtgcctggattagcttctttgattattgtgcctttgcttttgtatattatttatccccctacggttaagagtagtcctgatgcgcctaaattggctagagagaaattggagaagatggggccgatgactaagaatgagattattatgaccggcactctgttacttacggtggggctctggatttttggagggatgcttaatgtagatgctgttactgctgctattcttggattatctgtcctcctaatcactggtgtggtgacatggaaggagtgcttagctgaagcagttgcttgggataccctcacatggttcgctgccctcattgccatggctgggtatctcaataagtatggtctaatttcttggttcagccaaactgttgttaagtttgttggtggactgggtctttcatggcagctatcttttggcattttggttcttctctacttctactcccactacttctttgctagtggagcagctcatataggtgccatgtttacagcattcttgtctgttgccagcgctctaggtactccaccgtattttggtgccatggtattagcattcctttcaaacctcatgggtggccttacacactatggcatcggatctgcacctgttttctatggtgccaactacgtccctctcgcccaatggtggggttatggtttcctcatatctgttgtcaacattattatctggcttggaattggaggggtttggtggaagtttattggattatggtaaaatggtggccatgacaatttgccgatactctgattttgtttgatatccggtgggtggtctttcactttctgggttgctgttcagtgggaagtagttaagttttgtttctcattctttgtcgaagaaataatcttttggcgggaaacttcgaggggaagatgatatacgcatggtcaatttagagcagaaattagattttgcatctgaaattttgacatggcatatataggaagtgtctacaattccgacacagtgattagcagaatgcctgaataactctcgattttattttatttttttaccccgttcagtattttgtgaagtaaaggggtaatcatcaaaacatttctgtagttttatattttgatatatctgcttttaagattcatgatcaaatagtgttgacccgagtgaaacaaagaaatcacgtgtcttgggaaaactggaatttcttatgtgtatagtgagtggttgcttggatagttttattgaaactttgaaggctggatacctaaaaattcaggatgtttgacatgaaattcagtggatagtttccttgatgtagttgtccgtcgtgttgtctgccaacggtgtacaggttccgtaaattataagatcgacttctgccctt

SEQ ID NO: 4481 - DNA, 2158 bp, Prunus persica
ccgaaaatggcgtcgctcgccctcaccaccactctctcccccaccctccactctctcagatcccacgcttccttcccaaaagcgctacttctaaaaccgttttcagtctcccaaacccgccgaaactcccttaaaaccgccgctctcggtctcggtttcaacaaaaccctcatttcctcccccaaactcgcaaatttaacccgtgacttttctcccccccgccgtggcctctccgtcaaggccgctgcgacaaccggcggctcttcgatcactccggcggccaaggaaccatggcaaggcgctgccatgaagcccttgctcgcgtccattgcgacgggcgtaatcctctggttcgtgcccactcctgccggcgtcaccaagaatgcgtggcagcttctagcgattttcctcgccaccatcgtcggcatcatcacccagcccttgcctctcggagccgtcgccttgctcggcctcggcgcctccgtccttactaagacgctgactttcgcggcggccttctccgccttcggagatccaatcccctggctcatcgccctcgccttcttcttcgcccggggtttcatcaagaccggcctcggaaatcgaatcgcttaccagttcgtctctctcttcggtagttcctctctggggttagggtacagtctggtcttcagtgaagccctgttggctccggcgatcccatccgtctcggcccgagccggaggaattttcttgccgttggtgaagtcgctctgcgtcgcgtgcggtagcaatgtcggggacgggacagagggaaagttggggtcgtggttgatgctgacgtgtttccagacttcggtgatttcgtcggccatgttcttgacggccatggctgctaacccgttgagcgccaacttgactttcaacacgattaagcagacgattgggtggacggattgggctaaagctgcaattgtgcctggtttggtgtcgttgattgtggtgccgctgttgttgtatgtgatttaccccccggaggtgaagagcagccccgacgcgcccaagcttgccagggagaggctggagaagatgggccccatgtccaacaaagagattataatggctggcactctgcttcttacggttgggctttggatttttggaggagttttgaatgtagatgcagttactgctgccattcttggattatctgttctccttgttactggtgttattacatggaaggagtgcttagctgaatcagttgcttgggacacacttacttggtttgctgcactcattgcaatggctgggtatctcaacaaatacggtcttatctcctggtttagtcaaactgtcgttaagtttgttggcggattgggtctttcatggcagctgtcttttggcattctggttcttctctatttctactcccactacttctttgccagcggggctgctcatattggtgcaatgtttacagcattcttgtctgttgctagtgctcttggtactccaccatactttggagcgatggtgcttgcattcctctccaacctcatgggtggccttacccactatggtattgggtcggcacctgttttctacggcgctaactatgttccgcttggcaagtggtggggctatggattccttgtctccgtcgtcaatattattatttggctaggagttggaggggtttggtggaagttcatcggcttgtggtaaagggagttggccgtgaaaatctgccgactaaaaatccggcactgtttctgattacactcagatgctgtttcacttctctgctgaggcacgctattgatctttccctttaattctttcgcatggaaataatctttggtcatttcagggagaccttttgggtgaaatttggtatacataggaggtctatttttgagcagaaattagataatgtacccccaaattttgatgtagcattacaggtgttgtcttcaattcatgatcaccatttgttgtatgcttgttgaatctacccttatcttgtgccacatttattttctcagtggtgtaccaagaacaacacaagggctcctcacttcaccattctactttttacattgttagattcgattagtaggttttgagtgcttgggctacatataattggttgaatattccattacacattatcttt

SEQ ID NO: 4482 - DNA, 2085 bp, Artemisia annua
gtttatataaaaaccacaaaacgccgctcgtttgatttaacgatggcgtcgttatctctcaccccttccgttaacttagcctttcgtaaccgtcaatctcaaccgttaaatctaaccagatccaattgccacgtcagcactcatctcagatcatcatcatttacacctttaaaaaccactaactcaccgtcaccgttacttaacggcgccgttaaaaaaaccgttttcaccgttaaagcttcgtcatccgcggcggcggcgccggcggcgccgccgccggtgccgtggcaaggggcggcgatgaagccgctactagcttcgatagctacaggtgttataatatggtttattccagtacctaatggtgtgactaaaaatgcgtggcagttattgtctatttttttagctactattgtaggtataattacgcaaccgctgccgttaggcgcggttgcgttaatgggactaggagcgtgtgttttgaccaaaactttgacttttgcggccgctttttcggctttcggtgatccgataccttggttgattgctttagcgttctttttcgcgcgaggttttattaagactggcttagggaataggattgcgtatcagtttgtgaaattgtttgggagtagttcgttaggtttaggttatagtttagtttttagtgaggcgttattagcgcctgctataccttcggttagtgccagagctggggggatttttttgccgttggttaagtcgttatgtgtggcgtgtgggagtaatgttggtgatgggacggaagggaagttagggagttggttgatgttgacgtgttttcagactagtgttattagtagttctatgtttttgactgctatggcggcgaatccgttgagtgttaatttgacgtttaatactattaagcagacgattgggtggacggattgggctgtggctgcgattgtgcctggtttggttagtttgattgtggtcccgttgattttgtatattatttatccgccgtcggttaagagtagtcctgatgcgcctaagcttgcgaaggagaagttggagaaaatggggcccatgactaagaatgaaatcatcatgggtgggactttgcttcttacggttggtctgtggatatttggagggatgcttggtattgatgctgttacagctgctatccttggattgtctgttcttcttataactggagtcgtgacatggaaggagtgcttaggtgaagctgttgcatgggatacccttacatggttcgctgcactcattgcaatggctggttaccttaacaaatatggtctcatctcctggttcagtgaaacggttgtcaagtttgttggtgggctaggtcttcaatggcaagcatctttcggcattctcgttcttctgtacttctactcccactactttttcgcaagtggggctgctcacattggtgccatgtttaccgccttcttatccgtcgccagtgcactcggaacaccaccactatttgcagccatggttctagccttcctttccaaccttatgggtggtctaacccactacggaatcggatcagcccctgtattctatggagccaactatgtccctcttggcaaatggtggggctatggtttcatcatctccgtggtcaatatcatcatctggcttggagttggtggagtctggtggaagttcattggcttgtggtagaaaatcagaggtaccaatttactatcacaactcagtcacaaaaatccgaaagtttctgacatctaatgcgctgttagtaggattttaaccaaatcctttcggtatcaaaaccggttgcaagattttttttccaggaccttttcaccttgcaaataaattttgtgtatttgttggagtattgtgtaggttaaaatggtatacatgaggcccatttatatttaaggttgaaatttctactataaatttttgatatggcacacatttgattactgcttaaggcttctcttttggtggttttacattctttatggattcttggtgcacttcacgcatgtaatctagagagatactggcaccagttccaactttgtatcatattactat

SEQ ID NO: 4483 - DNA, 2019 bp, Helianthus annuus
cgggggttcacttattctaaccacacacaaacagatccctgatcccgcctttaacctgcaaaacgccgtcgtttcgccgtaacgatggcgtcactagctctaaccacctccgttaacctagggttccggtcaccaaccaccgttaaccaccgtctctccaccaaacaatctccggcgttcaatctccaccgatccaacggtccacaccacctccgattaccgtcgctaaaactcaaatcgacgatcagaaaccctaatttcaccgtaaaagcatcggcggcagcagttccggcgaaaccggatgctccggcgccggcgccggtaccatggcaaggagcggcgatgaagccgctaatcgcttcaatcgctaccggtgtaatcctgtggtttgttccggtaccggcaggagtttcgaagaacgcgtggcagttactggcgatatttctcgcaacgatcgtcggaatcatcacacagccgctgccgctcggtgctgtagcgttattaggtctaggtgcgtgtgtgttaaccaaaaccctaacatttgcagctgcattttcggctttcggtgatccgatcccgtggttaattgctcttgcgtttttcttcgctagaggattcattaaaactggattaggtaacagaattgcttatcagtttgttaaactgtttggtagctcgtcgttagggttagggtatagtttggtgtttagtgaggcgttgttagcgcctgcgattccgtcggtttcagctagagcaggggggatatttttgcctttggttaagtcgttatgtgttgcttgtgggagtaatgcaggggatgggactgaacataagttaggggcgtggttgatgttgacttgttttcaaacgtcggttattagttcgagtatgtttttgactgcgatggctgcgaatccattgagtgcgaatttgacgtttaatacgattaagcagacgattggttggacggattgggctgtggctgcgattgtgccagggattgtttcgttgattgttgtgccgcttattttgtatgtgatttatccgccgactgtgaagagtagtcctgatgcgcctaagcttgcgaaagagaagctggagaagatggggccgatgaccaagaatgaaattattatggcgggaactttgcttcttacggttggtctgtggatatttggaggaatgcttaacgttgatgccgttacggctgccattcttggactatccgtcctccttataaccggagtcgtaacatggaaggaatgcttaggtgaagctgttgcatgggatacccttacatggtttgccgcactcatcgcaatggctgggtacctcaacaaatatggcctcatctcttggtttagtcaaacagtggtcaaatttgttggtgggctaggtcttcaatggcaagcgtcttttggcattcttgtacttctatacttttattcgcactactttttcgcaagtggagctgctcatattggtgccatgttcactgcctttttgtcggttgctagtgcccttggcacaccgccattatttggagccatggtcttagccttcctctccaacctcatgggtggtctgacccactatggaatcgggtcagcccctgtgttctatggagccaactatgtccctcttgccaaatggtggggctatgggtttctcatctctgtggtcaatatcatcatctggcttggagttggtggagtctggtggaagttcattggcttgtggtagactaaaggtagtaccgatttactaccataactcaatcacaaaaatcagaaaaaggtttctacaaatgtgaggtttgtagcatttttggctaaatcctatcggtcttgaatctggttgcaagattttcacgggaattctttcaacttgcaaatacttttgtaactttgatagagaattgtgtaggttaagacgatatacatggcatgatgcccatttgtatctgaacatggaatttctactcataattttcgatgatattaagagacgttttacccc

SEQ ID NO: 4484 - DNA, 1969 bp, Vitis vinifera
gggttccgccctttctctcgcggccaatcgccgccgtccatttctttcctcagatccagatccacatccaatggcggcaagcagttccaacagagtttgttaactaccaccactaaccccctgcgagttccctcgccaatctcacagaccaatcgcgttgcgagaaagctaaccaccgtcgttcgcgcttcttcctccactgccgtcacctctaatcccaatccgccatggcagggcgcggcgctgaagccgctcgctgctgcgatcgccaccggggtcatcctatggttcgtgccgcagccggccggtgtctcgaggaacgcgtggcagctgctcgcgatcttcctcgccaccatcgtcggcatcatcacgcagccgctgccgctcggagccgtcgcgctcctcggcctaggcgcatccgtgctcaccaaaactctcactttcgccgctgccttttccgctttcggcgatccgatcccgtggcttatcgcgctcgctttcttctttgccagaggttttatcaagaccggactcggcaatcgcattgcctatcagttcgtttcgctcttcggaagttcatcgttggggctagggtatagtttagtgttcagcgaagctttgctggcgccggccataccgtccgtgtcggcgagagccggcggaatttttcttccattggtcaaatcactctgtgttgcctgcggtagcaatgttggagacggcaccgagaatcggctggggtcttggttgatgctcacttgtttccagacgtcttgcatttcgtctgccatgtttttgacaggaatggctgcgaacccgttgagtgcaaatttgacttttaacactatcaagcagactcttgggtggactgagtgggcgaaggctgcgtttgtgcccggtttggtgtccttgattgttgtgccattgcttttgtatgtgatttatccgcccactgtgaagagcagtcccgatgcaccaaagcttgctagggagaagctggagaatatggggcctatgtctcggaatgagattataatggcggtgactctgcttctcacggtggggctgtggatttttggaggtgtgctgaatgttgatgctgttactgctgcaattctggggttatctgtcctccttgtgactggggttgtgacatggaaggagtgcttagcagaatcagttgcctgggataccctcacatggtttgctgcacttatcgcaatggcagggtatcttaacaaatacggtctcatctcctggttcagccaaactgtagtaaagtttgttggcggattgggtctttcatggcagctatctttcagcattctgcttctgctctatttctactctcactatttctttgcaagtggagctgctcatataggtgccatgttcacagccttcttatcagttgctagtgccctaggcactcctccatattttggagccatggtgctggccttcctttccaacctcatgggtggcctcacccactatggcattggatcagcacccattttctatggtgccaactacgtatccctggccaaatggtggggttatggattcctcatatccatcgttaatattgttatctggcttggagttggtggggtgtggtggaaggccattggcttgtggtaaaattcttgccaaacgaaagttggtaattttctgattttttttccacctaggcgtagtttcaacttttttgtttggtttggaggtaggctgttaatttattacttttgattctttacctcaaaaataaacattttattgttacgcaaggaggaaagttattacttgtacctgaaattttgatatggcgggacgactgctggcgtatatgagcttacaatttatgatacagggattggttggatggttgaatgtttctctcttgctgctgttgtatttatcttttctttttctttttctttgttttttttggtgcctttgttaagat

SEQ ID NO: 4485 - DNA, 2276 bp, Gossypium hirsutum
cacatctcaatagccaaccataaattccaaacctccacacccaccgtatgatcaaaatcaaacggccagcgttaaccctctcccatcatttacccttttaaatataatctccgccttccttcactcagttccaccatttctcgtttctccgccgtcgacgcaaccgtcttaaatggcctccgtcgcactcacctcctcctgccccctcggttactcacgtatcaaatcacttgctttctcttccagatcatgtccaaacccggtcttttcccctccgtttctcccaaagtccacttcacataattccagcttcattaaacagttaagtctcactccagtcataacgaacaatagaatccagaaaagacacagcaaattaactgtcaaagcggcggcatcaactccagccgccgtaactccgccgtcccagcaaccatggcaaggtgcagcattaaagccattgatagcctcgattgctacaggtgtcattctctggttccttcccgtcccatccggtgtctctcgtaacgcctggcagttactttccattttcctcgccacaatcgtcggcatcatcactcaaccattaccactcggagctgtggctttacttggactaggcgcttccgtcctcaccaaaaccctaaccttttccgctgccttctccgcttttggcgatcccattccttggctaatcgctctcgccttcttcttcgctcggggtttcatcaagactggacttggtaatcgaatcgcttaccaattcgtttccttattcggatcttcctcattaggtttaggctacagcttagtcttcagcgaagctttattagcgccggcaattccatccgtatccgcacgcgctggaggaattttcctccctctagtcaaatctctctgcgccgcgtgtggcagcaacgtgggtgacggaacggaaaatagattaggatcttggttaatgctgacatgtttccaaacttccgttatttcttcttcgatgtttttaactgcaatggcggcgaatccattaagtgctaatttagctttcaataccattaaacagcagatcgggtggatggattgggctaaggcggcattcgtgccgggtttagtttcgttgcttgttgtgccattgattttgtatgttatttatccaccaacggtgaaaactagtcccgacgcgccaaagcttgctagggagaaactggagaagatggggccgatgtccaagaatgagattatcatggctgggactctatttctaacggtggggctctggatttttggaggggtgttaaatgtggatgctgttactgctgccattcttgggttatctgtcctacttgtgactggggtagtaacatggaaggagtgtcttgctgaatcagttgcatgggatacacttacttggtttgctgcactcatcgctatggctgggtatttgaacaaatatggtctcatctcatggtttagtcaaaccgttgttaaggtcgtaggtggattaggtctttcatggcaaatgtcatttggcattctggttcttctctatttctactcgcattacttctttgccagtggagctgctcatattggtgccatgtttacagccttcttgtctgtggctagtgctttgggcactccatcgtatttgggagcccttgttctatcattcctctccaacctaatgggaggcattactcattatggaattggatccgcacctgtattctatggggcgggctatgtaccactagcaaaatggtggggatatggtttcctgatatcggtggtgaatattataatctggcttggagtaggaggcatctggtggaaggctatcggcttgtggtaaggcagaatgtcataaaatttgctgatactgagctaagaaggatttctcacctaacttgaagtttacagtttcttcttcacatcggaaactgatttgtctttgattctttacgttgcagaaataatctttatagtggggtggggtttagagggttggaaaaagaagaaagatttgagtttgaggtggaggtattagagcagaacttagatctttaccacaaattttgacaaatggaaaatacattattattttgaatacgaatttttgggttatggattatgagacaaggtaaggtggtgcaaaacaatgtcacggttttattgtattttataaaattcctgttggttgggttcttttgttagaaatgtcacacgcaattcattttgagttagaactctaatggaattttttgccttcatccttt

SEQ ID NO: 4486 - DNA, 2270 bp, Gossypium hirsutum
  misc_feature (622)..(622): n is a, c, g, or t
  misc_feature (790)..(790): n is a, c, g, or t
cacatctcaatagccaaccataaattccaaacctccacacccaccgtatgatcaaaatcaaacggccagcgttaaccctctcccatcatttacccttttaaatataatctccgccttccttcactcagttccaccatttctcgtttctccgccgtcgacgcaaccgtcttaaatggcctccgtcgcactcacctcctcctgccccctcggttactcacgtatcaaatcacttgctttctcttccagatcatgtccaaacccggtcttttcccctccgtttctcccaaaatccacttcacataattccagcttcattaaacagttaagtctcactccagtcataacgaacaatagaatccagaaaagacacagcaaattaactgtcaaagcggcggcatcaactccagccgccgtaactccgccgtcccagcaaccatggcaaggtgcagcattaaagccattgatagcctcgattgctacaggtgtcattctctggttccttcccgtcccatccggtgtctctcgtaacgcctggcagttactttccattttcctcgccacaatcgtcggcatcatcactcaaccattaccactcggagctgtggctttacttggactaggngcttccgtcctcaccaaaaccctaaccttttccgctgccttctccgcttttggcgatcccattccttggctaatcgctctcgccttcttcttcgctcggggtttcatcaagactggacttggtaatcgaatcgcttaccaattcgtttccttattcggatcttcctcnttaggtttaggctacagcttagtcttcagcgaagctttattagcgccggcaattccatccgtatccgcacgcgctggaggaattttcctccctctagtcaaatctctctgcgccgcgtgtggcagcaacgtgggtgacggaacggaaaatagattaggatcttggttaatgctgacatgtttccaaacttccgttatttcttcttcgatgtttttaactgcaatggcggcgaatccattaagtgctaatttagctttcaataccattaaacagcagatcgggtggatggattgggctaaggcggcattcgtgccgggtttagtttcgttgcttgttgtgccattgattttgtatgttatttatccaccaacggtgaaaactagtcccgacgcgccaaagcttgctagggagaaactggagaagatggggccgatgtccaagaatgagattatcatggctgggactctatttctaacggtggggctctggatttttggaggggtgttaaatgtggatgctgttactgctgccattcttgggttatctgtcctacttgtgactggggtagtaacatggaaggagtgtcttgctgaatcagttgcatgggatacacttacttggtttgctgcactcatcgctatggctgggtatttgaacaaatatggtctcatctcatggtttagtcaaaccgttgttaaggtcgtaggtggattaggtctttcatggcaaatgtcatttggcattctggttcttctctatttctactcgcattacttctttgccagtggagctgctcatattggtgccatgtttacagccttcttgtctgtggctagtgctttgggcactccatcgtatttgggagcccttgttctatcattcctctccaacctaatgggaggcattactcattatggaattggatccgcacctgtattctatggggcgggctatgtaccactagcaaaatggtggggatatggtttcctgatatcggtggtgaatattataatctggcttggagtaggaggcatctggtggaaggctatcggcttgtggtaaggcagaatgtcataaaatttgctgatactgagctaagaaggatttctcacctaacttgaagtttacagtttcttcttcacatcggaaactgatttgtctttgattctttacgttgcagaaataatctttatagtggggtggggtttagagggttggaaaaagaagaaagatttgagtttgaggtggaggtattagagcagagcttagatctttaccacaaattttgacaaatggaaaatacattattattttgaatacgaatttttgggttatggattatgaggcaaggtaaggtggtgccaacaatgtcatggttttattgtattttttaaagtgcctgtcgggttcttacctctgtttactttgagttagaactctaatggaattttttgccttcatccttaaaaaaaaagaaaaa

SEQ ID NO: 4487 - DNA, 1725 bp, Manihot esculenta
atggcgtcgctagctctcacatcctcgtcttcgtgctctcttgcctttaattgtcttccttctctcaagtctcgctctctctcccacatcagatccactccaaatcgcgttcctttcctccctaaactcactgctaattccagatttcctctctcccattccttccttccaaaattctccaaatccaatgtcgctactgcaaccgcaatctctcagaagcggagaaatttaaacttaacggtcaaagcatcagtctcagcatcatcacctgcttctgcttctgcttcttcttcttctacacagccatggcagggcgcggctatcaagccattacttgcgtcaattgccacaggtgttattctctggttcgttccggttccatctggagtctcgcggcctgcttggcaactacttgcaatttttcttgccactattgtcggcatcatcacgcaacctttacctttaggtgctgttgccttgatgggtttaggtgcttcagtactcaccaaaactttaactttctccgccgcattttcggctttcggcgatccgatcccgtggttaattgcacttgctttctttttcgctcgaggatttattaagactggacttggaaacagaatagcttaccaattcgtatcgctttttggatcttcttcgttaggtttaggttacagtctcgtgtttagtgaagcattgttagcacctgcaattccatcagtttctgctagagcgggagggatctttttaccattggtgaaatcattgtgtgttgcttgtgggagcaatgttggcgatggtaccgagaataagcttggctcgtggttaatgttaacttgtttccaaacatcggttatttcttcttcgatgttcttgactgccatggcagctaatcctttgagtgccaatttgacattgagtacgataaagcagacaattggatggacagattgggctaaggcggcctttgtgcctggattggtgtctttgcttgttgtgcctttgctcttgtatataatttatccgcccacggtgaagaccagcccggatgcgcctaagttggctagggagaagttggagaagatggggccaatgactaagaatgagatcattatgactggaactttgcttcttacggtgggcctctggattttcggatcaaagttgaatgtggatgccgttactgctgctattctcggattgtctgtcctccttatcactggtgtagtgacgtggaaggagtgcttagctgaatcagtagcctgggataccctcacatggtttgctgcgctcattgcgatggctgggtatctcaataagtatggtctaatctcttggttcagccaaactgtagttaagtttgttggtggactgggactttcgtggcagctatcttttggcattttagttcttctctatttctattctcactacttctttgccagtggagcagctcatattggtgccatgtttacagccttcctgtctgttgccagtgctctaggtactccaccatattttggagccatggtactatcatttctttccaacctcatgggtggccttacacactatggcattggatctgcgcctgttttctatggggccaactatgtgcctcttgccaaatggtggggttatgggttcctcatatctgttgtcaacataattatctggcttggagttggaggggtatggtggaaggccattggtttgtggtaaagg

SEQ ID NO: 4488 - DNA, 1990 bp, Aquilegia formosa
cttcttctctgaacttgacgaaatttcatcttacttacgccattcatggcgtctttagcgttaacttgttcaccttcttcttgtaatctaggttttcgatctctatcaagttgtagatctcgttcaatcaaaccttcttcttcatcactaaatcttcaatctacaaccagatccaagatctctttaaatcaaaatcatcttttttcattttcaaatccattaagaaatgacattgttttgaaatctactacttcttctttaccaaatcgaagaagtttaatagttcaagcatcatcaacttcaaatccagtagtaccagctgaaccatggcaaggagcttcaatgaaaccattattagcttcaattgcaactggagtaattctatggtttgttccagttccagctggcgtaacgaagaacgcttggcaattacttgcaatttttcttgctacaattgttggaattattactcaaccattaccattaggagctgttgctttgatgggattaggtgctgctgttcttactaaaactcttacctttgctgctgctttttctgctttcggtgatccgatcccttggttgattgctcttgctttcttttttgctagaggttttattaaaacaggacttggtaatcgaattgcttatcaatttgtgtctttatttggtagttcatcattaggtttaggttatagtttggtgtttagtgaggcattattagcacctgctattccatctgtgtcggcaagagctggtgggatttttctcccacttgtcaaatcactttgtgttgcttgtggtagtaatgttggagatggaacagaaaggaaattgggctcatggttgatgcttacttgttttcaaacttcagtcatttcgtcatccatgtttcttacagctatggctgcaaatcctttgagtgcaaatttgacaatgaataccatacaacagaacattagttggactctttgggccaaagctgcttttgtgccaggtttagtgtcgttaattgtggttccgttcttgttgtatatcatctatccaccaactgtaaagagcagtcctgatgcacctaaacttgcaaaggaaaatttggcaaagatggggccaatgaccaagaatgagactataatggcagtcacccttcttctcacggtcgggctttggattttcggaggagcgctgaaagttgatgcggtcactgctgccattcttgggctttctgtccttctaacaactggagtggttacttggaaggaatgcttgggtgaagcagttgcctgggatactctcacttggtttgctgcactcattgccatggctggctacctcaacaaatatggtctaatttcctggttcagcgagaccgtagttaaggttgtaggtgggcttggtctttcatggcagttgtcctttggaattctggttctgctctacttttactctcactacttttttgcaagtggagctgcccacattggtgctatgttcacagcattcttatctgtagcaagtgctctaggaactcctccactctttggtgccatggtactcgcattcctctccaacctcatgggtggactcacccactacggtattgggtccgcaccagttttctacggagccaactatgtacctttggctcagtggtggggttatgggttcctgatctctgtcgttaacatactcatatggctcggcgttggaggtgcttggtggaagttcattggcttgtggtaataggcatacataagtgttgctggtttgatacttcaaaaattcaagaactttctggtttgtgtatgtttcagggacggccacatttttctttttctttttcatatatgatgccggcaattttttttcccactttgattctttatgttataggttattggaaccattgatgttgaccttggaaagtaggtatacagataaacaggtctgtttggaacagaggctagaatttgtatctaaattttgatgg

SEQ ID NO: 4489 - DNA, 2132 bp, Manihot esculenta
caaaccaccaaatgacgtccctagctctcacaatgtcttcttcatgctctctcgccttcaattctcgtccttctttcaagtccccatctctctcccacttcagatcctctgcaactcgccttccctccttccctaaactcaccgctaatattagattttctcccgcaatttcttaccttccgaaattctccaaatccgatgcagtcaccgccaccgaagtctttcagaaacggagaagctttagcttaacggtcaaagcatccgtcgctgctgcatcacctgcttcttctactcctccctcgcagccatggcatggcgcggctatcaagccattactagcatcaatagccacaggtgtcattctctggttcattcctgttccatctggagtctcgcgacccgcttggcaactgctcgccatctttctcgcaactattgtgggcatcatcacgcaacctttgcctctcggcgccgtcgccttgatgggcctaggtgcttcagtactcaccaaaaccttaactttctctgccgcattttcagctttcggggatccgatcccgtggttaatcgctcttgcattctttttcgctcgaggatttattaagactggacttggaaacagaattgcttaccaattcgtatcgctttttggatcttcttcgttaggtttaggttacagtctcgtattcagtgaagctctattagcgcctgcgattccttcagtttctgctagagcaggagggatctttttacctttggtgaaatctttgtgcgttgcttgtggtagtaatgcgggtgatggtactgagcataagcttggctcctggttaatgttgacttgtttccaaacatcggtgatttcttcttccatgttcttgactgccatggctgccaatcctttgagtgccaatttgactttcaatacgattaagcagacgattggatggaccgattgggctacggcggcgattgtgcctggattggtgtcgttgtttgttgtgcccttgcttttgtatataatttatccgcccacggttaaaagcagccctgatgcgcctaagttggctagggagaaattggagaagatggggccaatgactaagaatgagattattatggctggcactctgcttcttacggtaggcctctggatttttggatcaaagctgaatgtagatgctgttactgctgctattcttggattatctatgctccttatcactggtgtggtgacatggaaggagtgcttatctgaagcagtagcctgggacaccctcacatggtttgctgctctcattgccatggctgggtatctcaataagtatggcctaatctcttggttcagccaaaccgtagttaagtttgttggtggactgggtctttcatggcagctatcttttggcattttggttcttctctacttctactcccactatttttttgccagtggagcagctcatattggtgccatgtttacagccttcttgtctgttgccagtgctcttggtactcctccatattttggagccatggtgttgtcattcctttccaacctcatgggtgggcttacacactatggcattggatctgcacctgttttctatggtgccaattacgtacctcttgccaaatggtggggttatgggtttctcatgtctgttgtcaacataattatctggcttggaattggtgggatttggtggaaggccattggcttgtggtaaaagtggtgctcacgaaaatttgcccacccaaattctattcctgctcaggttttgttagctcttagatgacgcttttactttctggttttctatctcaatgggagatctttcgcttttgttgctgattctttgtcaaagaactaatcttccggtggagaacttggatggaaagattatatacacaatcggtttgtttggagcaaaaatcagaattagctcctgaagctgaaattttgacatggcgttgtaagtttgcaactgcctgcaattcatgattcattgtcagatgactgaatattcattcctcttttatgtagtatattgtgtttgcctgaaaagaaatattgatgtattaatgtgcagtattgtgtttgcctgaaaagaaatactaatatattaatgtgcagt

SEQ ID NO: 4490 - DNA, 1979 bp, Antirrhinum majus
  misc_feature (241)..(241): n is a, c, g, or t
  misc_feature (244)..(245): n is a, c, g, or t
  misc_feature (261)..(261): n is a, c, g, or t
  misc_feature (272)..(273): n is a, c, g, or t
  misc_feature (282)..(282): n is a, c, g, or t
  misc_feature (381)..(381): n is a, c, g, or t
  misc_feature (387)..(387): n is a, c, g, or t
  misc_feature (444)..(444): n is a, c, g, or t
  misc_feature (453)..(453): n is a, c, g, or t
  misc_feature (489)..(489): n is a, c, g, or t
  misc_feature (507)..(507): n is a, c, g, or t
  misc_feature (531)..(531): n is a, c, g, or t
  misc_feature (570)..(570): n is a, c, g, or t
  misc_feature (573)..(573): n is a, c, g, or t
  misc_feature (582)..(582): n is a, c, g, or t
  misc_feature (597)..(597): n is a, c, g, or t
  misc_feature (603)..(603): n is a, c, g, or t
  misc_feature (637)..(637): n is a, c, g, or t
tctctctctctgaactctaaacacttaaaggtccgatctttaccatcacaaacagaaaacagagcacgccataaaataaaaatggcgtctttagctctgacatcttccataaacctccgttttcgacccctctccgccccaaaaacccgcaccccactaaaatcccttcatcccactccaagattcaaatccctaatcaagaattgcgcttccaaatcatccaattcgaccccacctaacnacnncattgaccaaacccanttcgtcaattnnaaaccctcnttccaaaatcggtccctaatcacaatcccttccgcctccgccgcgccggcagttgttccaccaccgcctcaaccgtggcaaggagccgccattaaaccnctcttngcgtcaatcgcaacaggagtgatcctatggttcattccggcccccgagggagtttcncgcatcgcntggcagttgctgtccattttcttggccaccattgtnggaatcataactcagccnttgccgttgggagccgttgcgttnatggggcttggagctgctgttctcactaaaacactcacnttngcggctgcnttttcggcttttggngatccnattccgtggcttatcgcgttggcgttctttttcnctagagggtttatcaagacaggattgggtaacaggattgcttatcagtttgtttcgttgtttgggagttcgtctttggggttaggatacagtttggtgtttagtgaagcgcttttggcgcctgcgattccgtctgtgtcggctagagctggtgggattttcttgccgttggtgaaatcgctttgtgtggcttgtgggagtaatgtgggtgatgggactgagcacaagttgggttcttggctgatgctcacttgttttcagacatctgttatttcgtcgtctatgtttttgacagctatggcagcgaatccgttggctgctaatttgacggcgaatacgattaatatgtccattgggtggatggattgggctaaggctgccattgtgcctggattggtgtcattgattgtggtgccgatgcttttatatataatttatccgccaacggtgaagagcagtccggatgcacctaagcttgctaaggataagttggagaagatggggccaatgtctaagaacgagatcatcatggctggaactctgcttctcacggtagggctctggatctttggaagcactctgaatgttgatgcggttactgcagcaattcttgggttatcagtcctcctcataactggggttgtcacatggaaggaatgtctggctgaatcagttgcttgggacactcttacatggtttgccgcacttattgcaatggctggctatttgaacaaatacggtcttatttcctggttcagccagactgttgttaagtttgttgggggtttgggtctttcatggcagctatctttcggcattcttgttcttctgtacttctattctcactatttctttgctagtggcgctgctcacatcggtgccatgtttaccgcattcttatcagtagctactgctttgggtacaccaccttaccttggcgcgctcgttctctcattcctttccaatcttatgggtggaatcactcattacgggattggatcagcacccgttttttacggtgctggctacgtcccacttgcaaaatggtggggctatggattcttgatctctgtcgtcaatcttattatttggcttggagtcggagggttgtggtggaaggctatcggcttatattaaccatcctagtttttgatgtcacaagtgttggctattgcaacattttattgttgaaccaaatttttagtagctttgcctaaaagtggcataaagagatatgaatcatgatacacgatgaggctatctaaacctgagaatttggattgtgaaattttgacattgagatatgcatattctgactacttttttcatgagtcaaaaaaaaa

SEQ ID NO: 4491 - DNA, 2298 bp, Mimulus guttatus
ggagtttccgaagaaacccctgaaaaacctccaacctggccccctcactcaccgtatattccatcccccacatccaccgttagatcctaatccgacgctccatctctctctctctctctctctctctctcttctctctctctctctctctctctctcttcagtacacacacacctccatcccactcactctccaccatttccaaagaaaaaaattatttaaaagaaattccttcacaaccatttacgcattgatataagctttcagatctccatcgccggaaaacgccatcgattgaaatggcgtcgttagcactcacttcttccctcaacctccgctgccgccccctctccaccccaaatttccggccactcgccgcccccaaatccctccgcctcactcctagattcaaatctcccatcaagagcagcgtcaccaattccaacgatccactcggcgaagatcaattccaattccaattcaccgaacccaaaccctccgtcttccttcccgccccgaagcgagcagccacaaaagtcgcctccgcctcctcctcgccggctgtatctccgcctcccccacagccatggcagggggccgcgatcaagccgctcgtagcttccatcgcagtcggagttattctctggtttatcccagcacctaacggcgtctcccgcatcgcgtggcaactgctctcgattttcttagcaaccatagtcggaatcatcacccaacccttgcccttgggcgccgtcgcattgatgggcctcggcgcgtgtgtcctaaccaaaacccttacatttgcagctgcattctccgccttcggagatccgattccatggttgattgcacttgcattcttcttcgctcgagggtttatcaaaaccggattagggaaccgaatcgcctatcagttcgtctccttattcgggagctcgtctctagggttaggatacagtttggttttcagtgaagccctattagcccccgcgattccctcggtttccgcacgagccggtgggattttcttgccgttggttaaatcgctctgtgtggcttgcggtagtaatgtgggtgatggaacagaggagaaattgggttcgtggctgatgcttacgtgtttccaaacgtctgttatttcgtcttcgatgtttttgacggctatggctgccaatccgttggctgctaacttaaccgcgagtaccataaatatgaccattggatggatggattgggctaaggctgcgatcgtgcctggattggtgtcgttgattgttgtgccgttgttgttgtatataatctatccgccgacagttaagagtagccccgatgcccctaagcttgctaaggagaagctggcgaagatggggcccatgtcgaagaatgaaatcattatggcaggaactttgcttctcacggtcgggctctggattttcggaagcgccttgagtgtggacgcagtcacggcagcaattctcggtttatcggtcctacttataactggggtcgtcacttggaaggaatgcctagctgaatcagttgcttgggacactcttacttggtttgctgcactcattgcaatggctggttatcttaataaatacggtctcattacctggttcagccagagtgttgttaagtttgtgggtggattaggtctttcatggcagctatctttcggcattctcgttcttctctacttctattcccactatttcttcgccagcggagcagctcacatcggcgctatgttcacagcattcttatctgtagccagtgctttaggcacaccaccgtacctcggtgcagtggtcctagccttcctttccaatctcatgggcggaattacccattacgggattggatctgcacccgttttttacggtgcgggttatgttcctctcgctaaatggtggggctacgggtttttgatctccatcgtcaatcttgtgatctggcttggagtcggaggtgcgtggtggaagttcctcggcttatggtagacctgcgcacgggggattcatttgctctcgtagaattttatgtccgtttctgcataatttgcaccatattcggttcctccttttcgagatctttcgaaccttttataatggaaccgagattttagtagctttgccggagagggtcttagctagatttttttatttatcgccgtattttgagttaaatttttcatttcgatttacgcaatctatgtgatattaaattcttataataacagttgatgaaattgagaaaatggaggcagtgtactacaaggctaaaagcatattgaact

SEQ ID NO: 4492 - DNA, 2187 bp, Mimulus guttatus
ctccatctctctctctctcttctctctctctctctctctctctctcttcagtacacacacacctccatcccactcactctccaccatttccaaagaaaaaaattatttaaaagaaattccttcacaaccatttacgcattgatataagctttcagatctccatcgccggaaaacgccatcgattgaaatggcgtcgttagcactcacttcttccctcaacctccgctgccgccccctctccaccccaaatttccggccactcgccgcccccaaatccctccgcctcactcctagattcaaatctcccatcaagagcagcgtcaccaattccaacgatccactcggcgaagatcaattccaattccaattcaccgaacccaaaccctccgtcttccttcccgccccgaagcgagcagccacaaaagtcgcctccgcctcctcctcgccggctgtatctccgcctcccccacagccatggcagggggccgcgatcaagccgctcgtagcttccatcgcagtcggagttattctctggtttatcccagcacctaacggcgtctcccgcatcgcgtggcaactgctctcgattttcttagcaaccatagtcggaatcatcacccaacccttgcccttgggcgccgtcgcattgatgggcctcggcgcgtgtgtcctaaccaaaacccttacatttgcagctgcattctccgccttcggagatccgattccatggttgattgcacttgcattcttcttcgctcgagggtttatcaaaaccggattagggaaccgaatcgcctatcagttcgtctccttattcgggagctcgtctctagggttaggatacagtttggttttcagtgaagccctattagcccccgcgattccctcggtttccgcacgagccggtgggattttcttgccgttggttaaatcgctctgtgtggcttgcggtagtaatgtgggtgatggaacagaggagaaattgggttcgtggctgatgcttacgtgtttccaaacgtctgttatttcgtcttcgatgtttttgacggctatggctgccaatccgttggctgctaacttaaccgcgagtaccataaatatgaccattggatggatggattgggctaaggctgcgatcgtgcctggattggtgtcgttgattgttgtgccgttgttgttgtatataatctatccgccgacagttaagagtagccccgatgcccctaagcttgctaaggagaagctggcgaagatggggcccatgtcgaagaatgaaatcattatggcaggaactttgcttctcacggtcgggctctggattttcggaagcgccttgagtgtggacgcagtcacggcagcaattctcggtttatcggtcctacttataactggggtcgtcacttggaaggaatgcctagctgaatcagttgcttgggacactcttacttggtttgctgcactcattgcaatggctggttatcttaataaatacggtctcattacctggttcagccagagtgttgttaagtttgtgggtggattaggtctttcatggcagctatctttcggcattctcgttcttctctacttctattcccactatttcttcgccagcggagcagctcacatcggcgctatgttcacagcattcttatctgtagccagtgctttaggcacaccaccgtacctcggtgcagtggtcctagccttcctttccaatctcatgggcggaattacccattacgggattggatctgcacccgttttttacggtgcgggttatgttcctctcgctaaatggtggggctacgggtttttgatctccatcgtcaatcttgtgatctggcttggagtcggaggtgcgtggtggaagttcctcggcttatggtagacctgcgcacgggggattcatttgctctcgtagaattttatgtccgtttctgcataatttgcaccatattcggttcctccttttcgagatctttcgaaccttttataatggaaccgagattttagtagctttgccggagagggtcttagctagatttttttatttatcgccgtattttgagttaaatttttcatttcgatttacgcaatctatgtgatattaaattcttataataacagttgatgaaattgagaaaatggaggcagtgtactacaaggctaaaagcatattgaact

SEQ ID NO: 4493 - DNA, 2266 bp, Citrus sinensis
tttcactgatacgtcagagagagtttagttcccagagctcgaagccgctcaacaatggcgtctctggctctcactccatcttcttgctctctggggctccactctctcacatcacgctccctgaaactcacacccagatccacatccactcgattacactcttcgaactcaaattcaaattcgttgactcaaacaaacaatctcactttcagaaatcaatactttttgacaaacccatcattaaaattcaagagactaacagtacaagcttctgcttcagcgggagcagcagtggcgccagctccagagcagaagccacagcagccatggcagggagccgcgctgaaacccttgatagcctcaatcgccacgggattaatcctgtggttcgtccccgtcccgtccggcgtctccaaaaacgcctggcagttactcgccattttcctcgccaccatcgtcggaatcatcgcccagccgcttcccctgggcgccgtggctctgctgggccttggcgcctccgttttgaccaaaacattgacgttttccgccgccttctccgcctttggtgaccccatcccctggctcatcgccctcgccttcttcttcgcccgcgggttcatcaagaccgggctcggcaaccggatcgcttaccagttcgtcaagctgttcggatcctcgtctctcgggttgggatacagtctcgtgttcagtgaggcgttgttggctccggcgattccgtccgtttccgcccgcgccggcgggatctttttgcctatcgtgaagtctctgtgcctggcgtgcgggagtaacaccggggacggaacggagcataagttggggtcttggttgatgctgacgtgtttccaaacgtcagttatttcgtcgtctatgtttttgacggcgatggcagcgaatccgttaagtgccacgttgacattaaatacgattaatcagccaattgggtggatggattgggccaaggcggccattgtgcccggtttggtgtcgttgattgtggtgccattgctgttgtatattatttacccgcctactgtgaagagtagccctgatgcgccgaagctggctcatgagaaattggagaaaatgggacctatgagcacgaacgagaagattatggctggcactctgcttctaacggtagggctctgggtttttggtggtagactgaatgtggatcctgttactgctgcaattcttggattgtctatcctccttgtcactggggttgtgacttggaaggagtgcttagctgaatccgttgcttgggatactctgacatggtttgctgctcttattgctatggctggatatctcaacaaatacggtcttatcacctggttcagccaaactgtggtcaagtttgttggtggattgggtctttcatggcagctatcttttggcattctgattcttctctatttctactcccactacttctttgcaagtggagctgctcacatcggtgccatgtttacagccttcttatctgttgctagtgctctaggctgtccaccatactttgtagccatggtgctcgccttcttttccaatctcatgggtggtctcacccactatggcatcgggtcagcacctgttttctatggtgccaactacgttccccttgccaaatggtggggatacggattcatcgtatctatcgtcaacatcattatctggcttggagttggtggtgtttggtggaaattcattggtttgtggtaaagaggctgttacataaaaaaattgcagtttttctgattattgttggcctgcaggttagttttccaactggcgggtaacttttcttattgattctttaccatagaaataattatttggtggagaccttgattggagaaaacggtatagatctatatgaggtctatttatttagagcgggaagtaggtttgtatctgaaattttgacgccgcaaaaaaactaccttccgattattgattagtgattagttcagtttgatgcctgaatatcgcttgtatttttgcaaccttacttgtttttttttttcattttggtctctttgatggattaggttgttcttaaagtttccatgttgtatttacatctttcgaattcactcctgaaattaccgatttaatataagtttcaaaaatatatatatatatatttgaaacttatatatatatattccaatttcatgaaaaatgtcataatacatacatggaaccgcttaagaagggaaaaacaaatcagaacaaacgggag

SEQ ID NO: 4494 - DNA, 1381 bp, Brassica napus
tctgtgctcccctttaatccccagtttggaagatgcctagatatgatgatcgttacgggaacactcgtctgtacgttggacacttatcatccagaactcgtaccagagaccttgaacgccttttcaacagatacggaagagtgcgagatgtggatatgaagcgggattatgcttttgttgagtttagtgatccccgtgatgctgatgacgcgagacattacttggatggaagagactttgacggaagtcgcatcaccgtggagttttcaagaggggcacctcgtggctctcgggattatgacagcagaggcccacctcctggagcaggtcgctgctttaactgtggtgttgacggtcattgggcccgagactgcactgcaggagactggaagaacaagtgttaccgctgtggtgaaagaggacatattgagagaaactgcaagaacagtcccaagaagctcaggcggagtggaagctactccaggtcacctgtaagatcccgttctcctcgtcgtagaagaagcccgagccgtagcaggagtcttagccgtagccggagctacagccgatcaagatcccctgtgaaaagaagagagagaagtgaagaggagaggtctcgcagtccgaagagaatggaggactctctatcgccaagaggcagagaccgtagtccgattatggatgatgaaggtagcccaaggatcatagacgggagccctccaccttctccaaagcttgaaaagccagcaggatcagaccatgatggtggtagcagccctcaagacaatgggaatggcagaaacactgttgccagtcccgttgtgggacgtgacagtccgagagaggacagaagccccgttgatgatgattacgaggccaaccgtgcttcccctagaggaagcgagtcaccttgactttgatggctcatggcctcagggttgcaggtgctctagcatgttgtactattgaatcagactgccccccagatatttcctttctcttttatgtatgtttgctttggatcttcttgagttcatgttgtcaggagttcgttctttttaccctgttgagatgatggttaaaaacttgtaagacataaattgctagcttttcattttcaaaaaaaaaaaaaaaaaactcgaggggggggccccgtaccccaatttggccctattagtgagtcggatttacaaattcaactgggccggtcggttttaccaacggtccgtgaacttgggaaaaaacccccttggcggtaacccccaacatttaaatcggcctttggcaggcacaaataccccccttttttcgcccaaggtttgggtggtaaatttaagacgaagagagggcccccggcaccccggatacggccccttttcca

SEQ ID NO: 4495 - DNA, 1202 bp, Raphanus sativus
ggatacgctcttcttccccctttcggtttcgaaattagggtttcgctcagcgctctccttcaatccccagtcaggaagatgcctcgctatgatgatcgttacgggaacactcgtctttatgtcggacacttgtcatccagaactcgtaccagagaccttgaacgccttttcaacagatacggaagagtgcgagatgtggatatgaagcgggactatgcttttgttgagtttagtgatccccgtgatgctgatgacgcgagacattacttggatggaagagacttcgatggaagtcgcatcactgtggagttttcaagaggggcacctcgtggctctcgggactatgacagcagaggcccgcctcctggagctggtcgctgttttaactgtggtgttgacggtcattgggctcgagactgcactgcaggggactggaagaacaagtgttaccgctgcggggagagaggacacattgagagaaactgcaagaacagtcccaagaagctcaggcgaagtggaagctactccaggtcacctgtaagatcccgttctcctcctcgtcgtagaagaagcccaagccgtagcaggagtctgagccgaagctacagccgatcaagatccccagtgaaaagaagagagagaagtgtcgaggagagatctcgcagtccaaagagaatggaggactctctatcgccaagaggcagagaccgcagtccgattatggatgatgaaggtagcccaaggatcatagacgggagccctccaccatctccaaagcttgaaaagcaagcaggatcagaccatgatggtggtgttagccctcaaaacaatggtgatggcagcaacactgtgggacgcggcgctgacagcccgagagaggacagaagccccgttgatgatgattacgaggccaaccgtgcttcccctagaggaagcgagtctccttgactttgatggctcatggcctcaagtcacaggcactctagcatgttgtactattaatatcagacggctccagataatactttctcttttcatgtgtgtttgctttggatcttcttatgttcatgttgtcaggatttctttcttttactcaattgagatgatggttaaacttgcaagacattaatgggttggcttctcattttcagacaattttttgttggaagtatggataattaaaaacttgaaagttgagaaca

SEQ ID NO: 4496 - DNA, 1186 bp, Arabidopsis lyrata
ttcttccccctttcctttcgaaattagggcttccgggtttcgcagtgttctccttcaatccccagtttgaaaatgcctcgctacgatgatcgctatgggaacactcgtctttatgttggccgcttgtcatccagaactaggacccgagaccttgaacgtctttttagcagatacggaagagtgcgagatgtggatatgaagcgagattatgcttttgttgaatttggtgatccccgtgatgctgatgatgcgagacattacttggacgggcgagactttgatggaagtcgcatcactgtggagttttcaagaggggcacctcgtggttctcgagattatgatagcagaggcccacctcctggagctggtcgctgttttaactgtggtgttgacggtcattgggctcgggactgcacggcaggggactggaagaacaagtgttaccgttgtggagagagaggacacattgagagaaactgcaaaaacagccccaagaagcttaggcggagtggaagctactccaggtcacctgtaagatcccgttctcctcgtcgtagaagaatcccaagccagagtcttagccgaagccgaagctacagccgatcacgatccccggtgagaagaagagagaggagtgtggaggagagatcacgcagtcctaagcgaatggatgactctctatcgccaagagtcagagatcgtagtccggttcttgatgatgaaggcagcccaaagatcatagacgggagcccgccaccatcaccaaagcttcaaaaggaagacggatcagaccgtgacggtggtagcccccaagacaatggaaatggcagaaactctgttgtcagtcctgttgtaggagccggcggtgacagcctgaaagaggaccagagccctattgatgatgattacgagccaaaccgtgcttcccctagaggaagcgagtccccttaactttgatgcctcatggcctctcaggttgcaggcattgtagcatgtgtactattggatcgactgctagatacttcctctttaagtgtgtttgctttagacccttttaagttgcatgttatcaagagtttttctatttaagacataatgttgtggcgttttttgtttcggacaagttttcaaagattgttaaaaggatttataaaagtttcaatttgaggagaagacatgagtttgt

SEQ ID NO: 4497 - DNA, 1183 bp, Arabidopsis thaliana
taccttacgctgttcttcccctttccttccgaaattagggcttccgtgtttcgcagtgctctccttcaatccccagcttgacaatgcctcgctatgatgatcgctatgggaacactcgtctctacgttggccgattatcatcgagaactaggacccgagaccttgaacgtctttttagcagatacggaagagtgcgagatgtggatatgaagcgagattatgctttcgttgaatttggtgatccccgtgatgctgatgatgcaagacattacctggacggacgagactttgatggaagtcgcatcactgtggagttttcacgaggggcacctcgtggttctcgggattttgatagcagaggcccaccacctggagctggtcgctgttttaactgtggtgtagatggtcattgggctcgtgactgcacagcaggggactggaagaacaagtgttaccgttgtggagagagaggacacattgagagaaactgcaaaaacagccccaagaagcttaggcgcagtggaagctactccaggtcacctgtaagatcccgttctcctcgtcgtagaagaagcccaagccggagtcttagccgtagccgaagctacagccgatcacgatccccggtgagaagaagagagaggagtgtggaggagagatcacgcagtccaaagcggatggatgactctctatcgccaagagccagagatcgtagtccggttcttgatgatgaaggcagcccaaagatcatagacgggagcccaccaccatcaccaaagcttcaaaaggaagtcggatctgaccgtgacggtggtagcccccaagacaatggcagaaactctgttgtcagtcctgttgtaggagccggtggtgacagttcgaaagaggaccggagccctgttgatgatgattacgagccaaaccgcacttcccctagaggaagtgagtctccttaactttgatggctcatggccacggcttgcaggcattgtagcatgtatactattggatcgactgttcctttctcttttaagtgtgtttgctttagaaccttttaagtttcatgttaccaagagttttttcatttgagacataatgttgttgcgtttcttttggacaagttttcgaagattgttataaggatttataaaagtttcaatctgaggagaagacatgagtttgt

SEQ ID NO: 4498 - DNA, 1182 bp, Arabidopsis thaliana
accttacgctgttcttcccctttccttccgaaattagggcttccgtgtttcgcagtgctctccttcaatccccagcttgacaatgcctcgctatgatgatcgctatgggaacactcgtctctacgttggccgattatcatcgagaactaggacccgagaccttgaacgtctttttagcagatacggaagagtgcgagatgtggatatgaagcgagattatgctttcgttgaatttggtgatccccgtgatgctgatgatgcaagacattacctggacggacgagactttgatggaagtcgcatcactgtggagttttcacgaggggcacctcgtggttctcgggattttgatagcagaggcccaccacctggagctggtcgctgttttaactgtggtgtagatggtcattgggctcgtgactgcacagcaggggactggaagaacaagtgttaccgttgtggagagagaggacacattgagagaaactgcaaaaacagccccaagaagcttaggcgcagtggaagctactccaggtcacctgtaagatcccgttctcctcgtcgtagaagaagcccaagccggagtcttagccgtagccgaagctacagccgatcacgatccccggtgagaagaagagagaggagtgtggaggagagatcacgcagtccaaagcggatggatgactctctatcgccaagagccagagatcgtagtccggttcttgatgatgaaggcagcccaaagatcatagacgggagcccaccaccatcaccaaagcttcaaaaggaagtcggatctgaccgtgacggtggtagcccccaagacaatggcagaaactctgttgtcagtcctgttgtaggagccggtggtgacagttcgaaagaggaccggagccctgttgatgatgattacgagccaaaccgcacttcccctagaggaagtgagtctccttaactttgatggctcatggccacggcttgcaggcattgtagcatgtatactattggatcgactgttcctttctcttttaagtgtgtttgctttagaaccttttaagtttcatgttaccaagagttttttcatttgagacataatgttgttgcgtttcttttggacaagttttcgaagattgttataaggatttataaaagtttcaatctgaggagaagacatgagtttgt

SEQ ID NO: 4499 - DNA, 1017 bp, Brassica oleracea
gaagagtgcgagatgtggatatgaagcgggattatgcttttgttgagtttagtgatccccgtgatgctgatgacgcgagacattacttggatggaagagactttgacggaagtcgcatcaccgtggagttttcaagaggggcacctcgtggctctcgggattatgacagcagaggcccacctcctggagcaggtcgctgctttaactgtggtgttgacggtcattgggcccgagactgcactgcaggagactggaagaacaagtgttaccgctgtggtgaaagaggacatattgagagaaactgcaagaacagtcccaagaagctcaggcggagtggaagctactccaggtcacctgtaagatcccgttctcctcgtcgtagaagaagcccgagccgtagcaggagtcttagccgtagccggagctacagccgatcaagatcccctgtgaaaagaagagagagaagtgaagaggagaggtctcgcagtccgaagagaatggaggactctctatcgccaagaggcagagaccgtagtccgattatggatgatgaaggtagcccaaggatcatagacgggagccctccaccttctccaaagcttgaaaagccagcaggatcagaccatgatggtggtagcagccctcaagacaatgggaatggcataaacactgttgccagtcccgttgtgggacgtgacagtccgagagaggacagaagccccgttgatgatgattacgaggccaaccgtgcttcccctagaggaagcgagtcaccttaactttgatggctcatggcctcagggttgcaggtgctctagcatgttgtactattgaatcagactgccccccccccctccccagatatttcctctcttttatgtatgtttgctttggatcttctcgagttcatgttgtcaggagttctttctttttaccctgttgagatgatggttaaacttgtaagacataaattgttagcttttcgttttcagacaattttcaaaggttgttgaaagt

SEQ ID NO: 4500 - DNA, 984 bp, Brassica juncea
ttgagtttagtgatccccgtgatgctgatgacgcgagacattacttggatggacgagactttgatggaagtcgcatcaccgtggagttttcaagaggggcacctcgtggctctcgggattatgatagcagaggcccacctcctggttctggtcgatgctttaactgtggtgttgacggtcattgggcccgagactgcactgcaggggactggaagaacaagtgttaccgctgtggggagagaggacacattgagagaaactgcaaaaacagtcccaagaagcttaggcggagtggaagctactccaggtcacctgtaagatcacgttctcctcgtcgtagaagaagcccaagccgtagcaggagtcttagccgaagccgaagctacagccgatcaagatcccctgtgaaaagaagagagaggagtgtagaggagagatctcgcagtccaaagcgaatggatgactctctgtcgccaagaggcagagaccgtagtccgattatggatgatgaaggtagcccaaggatcatagacgggagccctccaccatctccaaagcttgaaaagcaagaccatgatggtggtagccctcaagacaatgggaatgacaggaaaactgatgccagtcccgtggtgggacgcgacagtccgagagaggaccgaagccccgttgatgatgactacgaggccaaccgtgcttcccctagaggaagcgagtcaccttgactttgatggcttatggcctcaagtcacaggcactctagcatgttgtactgtttaatcagactgccccagatatttactctctcttttatgtgtgtttgctttggatcttctcaagttcatgttgtcaggagttatttcttttactcaatggagatggttaaacttgtaagacattaatgggttggcttttcattttcagacaatttttgttgaaagtatggataattaaaaaatgatcgacgttgttacaatttgcaat

SEQ ID NO: 4501 - DNA, 1965 bp, Cajanus cajan
acaccctcttgttcttcttcttctttgttatcatccttcacctattacaagccacttcatccacactataacacaaacatggaactaagcaccatgttttgcttgtgtgcttcttttctcttcattgtcctcttcagaacactcatcaaatccaaacgccgtggtgacttgccactccctcctggctccatgggttggccttacataggagaaacctttcaaatgtactctcaagacccaaatgtcttcttcacctcaaaaattaaaaggtatggctccatgttcaagtcccacattctaggttgtccctgcgtgatgatttccagccctgaggctgccaagtttgtgctcaacaaagctcaactcttcaagccaacattcccagcaagcaaagagaggatgttgggaaaacaagccattttctttcaccaaggagagtaccatgctaacttgagaaggctcgttcttcgcaccttcatgccagaggccataagaaacatcgtacccgacattgaatccattgcccaagcttgcctcaaatcatgggagggtcgtttgatcaccactttccttgaaatgaaaacgttcactttcaacgttgctctgctttcgattttcgggaaagaggaaattctgtacagagaggctctgaaacggtgctactacactctggagcaagggtacaattcaatgccgattaacgtgccgggaacgctgttccacaaggcgatgaaggcaagaaaggagcttgcgcagatcgtggcccaaataatctctagcaggaggcagaggaagcaagattacaaggacttgttgggttcgttcatgggtgagaaagcagggctcaccgacgagcagatagcagataatgtaattggagtcatatttgcagctcgtgacaccacggccagtgtgctgacgtggatagtcaagtaccttggcgaaaaccctagtgtcctagaagctgttactgaagaacaagagtgcatattgaagagcaaggaagaaagtggagaagataagggtcttaattgggaggatgccaaaaagatgccaataacttcaagggttattcaggagactctcagagtggcttcaattttgtcttttaccttcagagaggcaatagaggatgttgaatatcaagggtatcttataccaaaagggtggaaagtgctccctctctttaggaacatacaccacagccctgaaaatttcaaggagccagaaaaggtttgatccctcaagatttgaggctgctccaaagcccaatactttcatgccatttggcagtgggacccacgcttgtcctggaaatgaattagccaagttggagattttggtcctcctacatcatctgaccacaaagtacaggtggtctgttatgggtgcaaaaaatgggattcaatatggtccttttgctcttccccaaaatggcttacccatcacattatatcccaagaagtagatatatcatcactcaaacaaatcacacatccaatccaattaattatccaaccctggttttatagtagctttctaaatatggaaagaatgacttcaactctaagctctcaaaattggtttccacattctcccaagataatgataaataccaacagaaccatattgcaattggataaccaaacaagggagatcatcaatcaactcttcctttctttttggccaagagaaacccaaaggggtagtcttgacaaatagcagcatacaaacagggatgtcaagtgtatataggaggtttcatagccaagagcagatagtatttaagttcttttcattttcttcactttttcttatttttaattattccttccaatatgaggaaaagtcctcaaaagattgtattgataaattcaactaattagttctgtatccataagaatgccgcaaggccaaaataaagggaaatattgctaccgatatgagttaatccaatgcataaat

SEQ ID NO: 4502 - DNA, 1898 bp, Phaseolus coccineus
aaattattcgtattcataacaatccttaatcacactcacatcaaacatggaactaagcaccatcttatgcttgggtgcttcctttctcttcatctttctcttcaggacactcatcaaacagtttctctccaaacgccctcacttcccactcccacctggcaccatgggttggccttatataggagaaacctttcaaatgtattctcaagacccaaatgtcttctttgcctccaaaattaaaaggtatggctctatgttcaagtcccacattctaggatgtccctgtgtgatgatttccagccccgaggctgccaagtttgtgctcaacaaagctcaactcttcaagccaacattcccagctagcaaagagaggatgttgggaaaacaagctatcttctttcaccaaggagagtaccatgctaacttgagaaggcttgttcttcgcaccttcatgcctgaagccatcaaaaacatcgtacctgacattgaatccattgctcaagattccttaaaatcctgggagggccgtttgatcaccactttccttgaaatgaaaacgttcaccttcaacgttgctctgctttcaattttcgggaaagaagagattctgtacagagatgctctgaaacggtgttactacactctggagcaagggtacaactcaatgcccattaacgttccggggacactgttccacaaggcgatgaaagcgaggaaagagcttgcgcagatcgtggcccaaataatctctagcaggaggcagaggaaacaagattacaaggacttgttgggttcattcatgggagagaaagcagggctcaccgacgagcagatagcagataatgtaattggagtgatttttgcagctcgtgataccactgccagtgtgctgacgtggattgtcaagtaccttggtgaaaaccccagtgtcctagaagctgttactgaagagcaagagtgcatattgaagaccaaggaagaaagtggagaggataagggtctgaattgggaagataccaaaaagatgcccataacttcaagggttattcaggaaactctaagagttgcttcaattttgtcttttactttcagagaagcagtagaggatgttgaatatcaaggatatcttataccaaaagggtggaaagtgctacctctatttaggaacatacaccacagtcctgacaacttcaaggaaccagaaaaatttgatccctcaagatttgaggctgcaccaaaacccaatacttttatgccatttggcagtgggatccacgcttgtccagggaatgaattagccaagttggagattttggttctcctacatcatctcaccacaaagttcaggtggtctgttgtgggtgcaaagaatgggattcaatatggcccttttgctcttccccaaaatggtttacccatcacactatatcccaagaagtagatactaaaaatcactcaaacaaatcacatatccaaccctggttttatagtagctttctaaatatggaaagaatgccttcacagctctcaaaattggtttccacactctccacataaagcataaagacacagaacatattgcaattggataaccaaacaagggagatcaacaactcttcccttctttttggccaagagaaacccaaagggggtagtcttgacaataataacaaacaacacagggatgtcaagtgtacataggaggtttcacagccaggtccagatcatagtattatgttcttttcatttcctcactcttttttttttctctattattttttctccttcagatatgaggaaaagtcctcagaagattgtattgatgaattcaactaattattagttctgtatgcataagaacgccgcaaggccaaaataaaagtgaaacgttgctactg

SEQ ID NO: 4503 - DNA, 1834 bp, Glycine max
tcacactaacacaaaaacatggaactaagcaccatgttttgcttgtgtgcttcgtttctcttcattgttctcttcagggcactcatcaaaccttattatgtctccaaacgccgtgacttgccactcccacctggctccatgggttggccttacataggagaaacctttcaaatgtattctcaagatccaaatgtcttctttgcctcaaaaataaaaaggtttggctctatgttcaagtcccacattctaggttgtccctgcgtgatgatttccagccccgaggctgcaaagtttgtgctcaacaaagctcaactcttcaagccaacattcccagcaagcaaagagaggatgttgggaaaacaagctatcttctttcaccaaggagagtaccatgctaacttgagaaggcttgttcttcgcaccttcatgcccgaagccataaaaaacatcgtacctgacattgaatccattgcccaagattgcttaaagtcttgggaaggccgtctgatcaccactttccttgaaatgaaaacgttcaccttcaacgttgctctgctttcaattttcgggaaagaagagattctgtacagagatgctctgaaacggtgctactacactctggagcaagggtacaactcaatgcccataaacgttccagggacactgttccacaaggcgatgaaggcaaggaaggaacttgcacaaatcgtggcccaaataatctcgagcagaaggcagaggaagcaggattttcacaaggaccttttgggttcattcatggatgagaaatcagggctcaccgatgagcagatagcggataatgtaattggcgtcatattcgcagctcgtgacaccaccgccagtgtgctgacgtggatcgtcaagtaccttggtgaaaaccccagtgtcctagaagctgttactgaggaacaagagtgcatattgaagagcaaggaagaaagtggagaagataagggtctaaattgggaagatgcaaaaaagatgccaataacttcaagggtcattcaggagactctaagagttgcttcaattttgtcttttactttcagagaagcagtagaggatgttgaataccaagggtatcttattccaaaagggtggaaagtgctacctctatttaggaacatacaccacagtccagacaacttcaaggagccagaaaaatttgatccctcaagatttgaggctgctccaaagcccaacacttttatgccatttggcagtgggatccacatgtgtccagggaatgaattagccaagttggagattttggtcctcctacatcatctgaccacaaagtacaggtggtctgttgtgggtgcaaagaatgggattcaatatggcccttttgctcttccccaaaacggcttacccatcacattatttcccaagagcaagtagataatcaatcacacatccaatacaaccctggcttcatagtagctttctaaatatggaaagaattgcttcatagctctcaaaattggtttccacagataatgataaagacacagaccatattgcaattggataaccaaacaaagggagatcaacttttcccttcttttttgtccaagagaaacctaaaggggtaatcttgacaaatagcatacaaacaggaatgtcaagtgtatatagaggaggtttcacagcctgagcagatagtattaagttcttttcattttcttattttttttatctttcaaatatgaggaaaagtcctcataagattgtattgatgcattcaactaattagttctgtatccataagaatgccgcaaggccaaaataaagtgaaacattggttctggga

SEQ ID NO: 4504 - DNA, 1862 bp, Glycine max
cttcttcttcttctttgtgttatccttcacacacctattacaagtcaagccactcaactcacactaacataaaaacatggaactaagcaccatgtttttcctgtgtgcttctcttctcttcattgttctcttcttcaggacactcatcaaaccttactatgtctccaaacgccgtgacttgccactcccacctggctccatgggttggccttacataggagaaacctttcaaatgtattctcaagacccaaatgtcttctttgcctcaaaaataaaaaggtttggctctatgtttaagtcccacattctaggttgtccctgcgtgatgatttccagccccgaggctgccaagtttgtgctgaacaaagctcaactcttcaagccaacattcccagcaagcaaagagaggatgttgggaaaacaagctatcttctttcaccaaggagagtaccatgctaacttgagaaggcttgttcttcgcaccttcatgccagaagccatcaaaaacatcgtaccggacattgaatccattgcccaagattgcttaaagtcttgggaaggccgtttgatcaccactttccttgaaatgaaaacgttcaccttcaacgttgctctgctttcaattttcggaaaagaagagattctgtacagagatgctctgaaacggtgctactacactctggagcaagggtataactcaatgccaattaacgttccgggaacactgttccacaaggcgatgaaggcaaggaaggagcttgcacaaatcgtggcccaaataatctggagcaggaggcagaggaagatgattgattacaaggacttgttgggttcattcatggatgagaaatcagggctcaccgacgaccagatagcggataatgttattggcgtcattttcgcagctcgtgacaccaccgccagtgtgctgacgtggatcgtcaagtacctcggtgaaaaccccagtgtcctagaagctgttaatgaggagcaagagtgcatattgaagagcaaggaagaaaggggagaagataagggtctaaattgggaagatgccaaaaagatgccaataacttcaagggtcattcaggagactctaagagttgcttcaattttgtcttttactttcagagaagcagtagaggatgtagaatatcaagggtatcttattccaaaagggtggaaagtgctacctctatttaggaacatacaccacagtccagacaacttcaaggagccagaaaaatttgatccctcaagatttgaggctgctccaaaacccaacacttttatgccatttggcagtgggatccacatgtgtccagggaacgaattagccaagttggagattttggtcctcctacatcatctgaccacaaagtacaggtggtctgttgtgggtgcaaagaatgggattcaatacggcccttttgctcttccccaaaacggcttacccatcacattatttcccaagaacaagtagatatcactcaaacaatggcttcatagtagctttctaaatatggaaagaattgcttcatagctctcaaaattggtttccatattgcaattggataaccaaacaagggagatcaacttttcccttctttttggccaagagaaacccaaaggggtagtcttgacaatagcatacaaacaggaagaatgtcaagtgtatatagaggaggaggtttcacagcctgagcaaatagtattaagttcttttcattttcttattttttttatccttcaaatgtgaagaaaagtcctcataagattgtattgatgcattcaactaattagttctgtatccataagaatgccgcaaggccaaaataaaagttaaattttggttctgagaa

SEQ ID NO: 4505 - DNA, 1778 bp, Lotus japonicus
cctccttcacctacaacaacaacaaacaaacactaactcataaagatggaacttagcatcaattttaccttgtttgtttcctttctcctcattgttctgttcaggttactcatcaagccctttatctctaaaaaacataacttaccactccctcctggttccatgggctacccttacataggagaaaccttccaaatgtattctcaagacccaaatgtcttctttgcctcaaaaatcaaaaggtatggctctatgttcaagtcccacattttgggttgtccctgcgtgatgatttcaagccctgaagctgcaaagtttgtcctcaacaaagctcaactcttcaagccaacattcccagcaagcaaagagagaatgttgggaaagcaagctatcttctttcaccaaggagagtaccatgctaacctgaggaggcttgtccttcgcgccttcatgcctgaagccgtcagaagcatcatcccgaacatcgagtccattgcaaaagattgtctcgaatcatgggaaggccgttcaatcaccactttccttgaaatgaagacgttcaccttcactgttgctttgctttcaatttttggaaaagatgagattctatacagagagcgtttgaaacagtgctactacacacttgaacaagggtataattcaatgcctattaaccttcccgggacacttttccacaaagctatgaaggcaaggaaagaactggcacagatcgtagcccaaatcatctcaagcaggaggcagagtaagcaagagtacaaggacttgttaggttcattcatgggtgagaaagcagggctcacagatgaacagatagcagataatgtaatcggagtcattttcgcagctagggacaccacagccagtgtgcttacgtggattgtcaagtaccttggtgaaaaccccagtgtcctacaagctgtgactgaagagcaagaaaacatattgaagagcaaggaagaagataagggtttgaattgggaagatgctaaaaacatgccaataacttcaagggttattcaggagactctaagagttgcctcaattttgtccttcactttcagagaagcagtagaggatgttgaatatcaagggtatctaataccaaaagggtggaaagtgctgcccctctttagaaacattcaccacagtccagagaacttcaaagatccagcaaaatttgacccctctagatttgaggttgctccaaaacccaatacattcatgccatttggcagtgggatccatgcttgtccagggaatgaattggccaagttggagattttggtcctcttacatcatttgaccacaaagtacaggtggtctgtggctggggcaaagagtgggattcaatatgggccttttgctcttccccaaaatggcttgcccatcacattatattccaagaagtaaatatcaccccaacaaaaggctaaacgtggaaacaaacaatgacttcaaagctgtcaaaattggttcccattttctcaaaagaaatgataaaggcagagaccaaattgcaaaatgtaaaaccaaacaagggaaattaagtgttggtttctttttggcttggagactcccaaagggtagtcttcatgattgaatactaacaggaatgtcaagtgtatataggagattcatagccagagcagatagttagagttcttatcattccttcacttttttttttgctttttcaaatatgaggaaaatcctcataggattgtattgatgaatttgatggtaatggatatcttgtt

SEQ ID NO: 4506 - DNA, 2100 bp, Medicago truncatula
ctagctggtagtagaaacaacaaactctcctctccttctcaccctcttcctacttcactattttacttcttaaatcctataaatacatcaaatcttcatcatttttttctcactcatcttattcattcatctctctctcttatcattcatatttttcatattttcacctataaccaacctttctactcactcacatactaaacatggaaattaccactttgtttttctactttgcttcttttctcttcattgttctgttcaaatcactcatcaaaaacttcttatttccttctaatggaaaacaattgcctctacctcctggttctatgggttacccttacataggagaaacctttcaaatgtattctcaagaccctagtcttttctttgccaacaaaatcaaaaggtatggtgctatgttcaagtctcacattttaggttgtccttgtgtgatgatttcaagtccagaagcagcaaaatttgtgttaaacaaatctcaacttttcaaaccaacatttccagctagcaaagaaaggatgttagggaaacaagcaattttctttcatcaaggaaattatcatgctaacctaagaagacttgttcttcgttctttcatgcctgaagccatcaaaagcattgttcctaatattgaatccattgcacaaacttgcctcaaatcatgggatggaaatttaatcaccacttaccttgaaatgaaaacattcaccttcaacgttgcacttctatcaatttttggaaaagatgaaattctatatagagaagatctaaaaagatgttactacacacttgagaaagggtacaattcaatgccaataaacctaccaggaacactatttcacaaggcaatgaaagcaaggaaagagcttgcacagatcttagaacaaatcatctcaacaaggaggtgcaaaaagcaagtttacaatgatttattagcttctttcatggatgagaaagcaggacttagtgatgaacaaatatcagataatatcattggtgttatttttgctgctcgtgacacaactgctagtgtgcttacgtggattgtgaagtaccttggtgaaaatcctagtgtccttgaatcagtcacagaagaacaaatgtctataataaaggggaaacaagaaaatggtgaagaaattggtctaaattgggaagacacaaaaaatatgccaataacttcaagggttatacaagaaactctaagagtggcatcaattttgtcttttacatttagagaagcaacagaagatgttgaatatcaagggtatcttataccaaaaggatggaaagtattgccacttttcagaaatatacatcacagtccagagaatttcaaagagccagaaaaatttgatccttcaagatttgaggttgctccaaaacctaatactttcatgccatttggaaatggggtccatgcatgtcctggcaatgaattagcaaagttggagattttggttcttgtacatcatctaaccacaaagtacaggtggtctgtggtcggtgaaaagaacggaattcagtatggtccttttgctcttcctcaaaatgggttaccaatcaacttatattccaagaaataaaaaaatatgaaccaaacataaagatggaggctggtcaaatatagcaaggaatcaactttctaaatttggaatggtttcaaaagtatgttaatgaatttgattaaactttgaccagaaaaagttgtgaagaggagagaccatataacaaatacctaaacaaagggatatcaaactttattccctttaaattttggccaagagacaccccaaaggggcaattttgacttttgaattaattgcacaaactaggagtcaagtgtacagaggttacattacatagccagagctaagctaacagtgtaaataacctcttttcattcatttttgtttttatttttttggttcatagtttttttacatttattttttattttaggatatattgaggaaaagtcctcaatagattggattagatgtaatgaagtaactagctttgtatccacatgaatgttgcaattcaaaaaaaaataatgaagctgtaacatttcaattcttt

SEQ ID NO: 4507 - DNA, 1984 bp, Cajanus cajan
ggggaaacataaatgagctggtgagagagattccgtgtctcgaaatttagctgtaatttcctccttcatatcatttcactctcaacaccctataaatacatccaatgttcaacttttttgtcacaacacacctagctcatatttcttctttcacttattcagtattcacccacaactacactatgttgtgcctctttgcttgttttcttctcattcttattatcttcaaatcactcatcaaacccaaagggagagaattgccacttcctcctgggaccatgggttggccttacataggagaaaccttccaaatgtattctcaagacccaaacgttttctttgccacaaaaatcaagaggtatgggtctatgtttaagtctcacattttgggttatccctgtgtgatgatttctgacccggaagcagcaaagtttgtgttgaacaaagctcaactcttcaagccaacatttcctgctagcaaagagaggatgttggggaaacaagcaattttcttcaccaaggagcataccatgctaaactcagaaggcttgtccttcgcaccttcatgcccgaagccatcaaagacatagtctctagcattgaatcaattgctcaaagttgcctcaaatcatgggaaggaaagatgatcaccactttccttgaaatgaaaaactttaccttcaatgttgccctgctttcaatttttggaaaagatgaaactctatatagagagtctctgaagagatgctactacacccttgagagagggtacaactcaatgcccataaaccttccaggaacactgttccacaaggccatgaaggcaaggaaagagcttgcacagatcttggctcaaatcatcttaaccaggaggaacatgaagcaagattacaatgacttgttgggttcattcatgagtgaaaaatcaggactcacagatgaacaaatagcagataacatcattggtatcatatttgctgctcgtgacaccacggccacggtgcttacgtggattgttaagtaccttggtgaaaaccctagtgtcttagaagctgtaactgaagagcaggagtctatattaaggggcaagaaagaaagtggagaagaaatgggtctgaattggtcagacacaaaaaatatgcctgtgacatccagggtcatacaggagactctaagaatagcatcaattttgtcttttactttcagagaagcagtagaggatgttgaatttcaagggtatctcataccaaaagggtggaaagttttaccactttttagaaacatacaccacagtccagacaacttcaaagagccagagaagtttgatccatcaagatttgaggttgctccaaaacccaatacttttatgccatttggcaatgggacccatgcatgtcctggcaatgaattagccaagttggagattttggtgcttctacatcacctgaccacaaagtacaggtggtctgcaataggtgcaaaaaatgggattcagtatggtccttttgcccttccacaaaatggattgcccatcacactatattccaagaaataaatatgcttcaaatgaaaagtggaggcacactaacatgacatgggaacaacttgctaaatatggaaatagtggctccaaagatatttcaattttgtttcacttgagaaagtgatgaaagagaccctaaataaacaaagtgggatggattcttcactttattttaaggccaaaagacaaccaaaggaaaggcttgagggaagttaattgtacagaggaggttcagatgtattaggttctttttattcttcattttttatttagttactttttcatttttccacttctaacggttctaattttccctgttatttttctttatattttcaaataatttgagaaaagtcctcaaaagattagatgtattgaactccctagctttgtatccatgcaatacagagaaaaaagaaaaagaaagtgaagatgaaatat

SEQ ID NO: 4508 - DNA, 1746 bp, Glycine max
atggaactcagcacgatgttgttcttgtttgtttctttcctaaccattcttttctctaaatcactcattaaatttttcttctcttccaaaggtagacaattgccacttcctcctgggaccatgggttggccttacataggagaaaccttccaaatgtattctcaagacccaaatgttttctttgccacaaaaatcaagaggtatgcttctatattcaagtcacacattttgggttatccttgtgtgatgatgtctgacccggaagcagcaaagtttgtactgaacaaagctcaactcttcaaaccaacatttcctgctagcaaagagaggatgttggggaagcaagcaattttctttcaccaaggagcataccatgctaatcttagaaggcttgttcttcgcaccttcaggcctgaggtcatcaaagacaaagtctcatacattgaatccattgcccaaagttgcctcaaatcatgggaaggaaaaatgatcacaactttccttgaaatgaaaacctttaccttcaatgtggccctgctttcaatttttggaaaagatgagaatctctatggggaggatctgaagcgatgctactacaccctcgagagagggtacaattcaatgcctataaaccttccaggaacactgttccacaaggccatgaaggcaaggaaagagcttgcacagatcttggctcaaatcatctcaacaaggaggaatatgaagcaagatcacaatgacttgttgggctcgttcatgagtgaagaagcaggactcagtgatgagcaaatagcagataacatcattggtcttatttttgctgctcgcgacaccactgccaccgtacttacgtggattgttaagtaccttggtgaaaacaccagtgtcctagaagcagtaactgaagagcaagagtcgatattaagggccaaggaagaaagtggagaagaaatgggtttgaattggtcagacacaaaaaatatgccagtgacatccagggtcatacaagagactctaagaattgcatcaattttatcttttacattcagagaagctgtagaggatgttgaatttcaagggtatctcataccaaaagggtggaaagtattaccactttttagaaacatccaccatagtcctgacaacttcaaagagccagagaagtttgatccttcaagatttgaggttgctctaaaacccaatacttttatgccatttggcaatgggacccatgcatgtcctggcaatgaattagctaagttggagattttggtgtttctacatcacctcaccacagaatacaggtggtctttgatcggagcaaaaaatggggttcaatatggcccttttgcgcttccacaaaatggattgcgcatcacactatatcccaagaaataaatatgatgaagataaaaagtggaggcacactaactatggcatggaagcaacttgctaaatggaaataatgcttccaaagatatttgaatttgttaacctagagaaggtgatgaatgagaccatatattaaaaaagggagagcaattttttcctttattttttggccaggagacaatcaaagaggaattcttgagattatcatacacagagggagggaaggcaattgtacaaatgaggtctcagccagatattcatcatatttttcacttaaatatatttttatccttttgataaatattcgattttttatttgtttcttaataaatttttgttttgaattgagtcctt

SEQ ID NO: 4509 - DNA, 1652 bp, Glycine max
gagagattctgtgtgtggaaatatttgagctgcaattgaaaacctccctctcttccctcctttcttgcttcacatcttttcactctcaagagcctataaatacctcaaatgttcaacattttttttctcacacaacacatacctccttataacttatcttaatttcttcttctttcaccattcacctacaattacaactatacaagcctgaagaacgtactcacactaaaccattattataattagacatggaactcagcactattatgttgtgcttgtttgcttctttcctatccattcttctgttcaaatcactcatcaaacctttcttcttctcttccaaagggagacaattgccacttcctcctgggaccatgggtttgccttacataggagaaaccttccaaatgtattctcaagacccaaatgttttttttgccacaaaaatcaagaggtatggctccatgtttaagtcacacattttgggttatccttgtgtgatgatttctgacccagaagcagcaaagtttgtgctgaacaaagctcaactcttcaaaccaacatttcctgcaagcaaagagaggatgttgggaaagcaagcaattttctttcaccaaggagcataccatgctaaccttagaaagcttgttcttcgcaccttcatgcctgaggccatcaaagacaaagtctctaacattgaatccattgccctaagttgcctcaaatcatgggaaggaaaaatgatcacaactttccttgaaatgaaaacctttaccttcaatgtggccctgctttcaatttttggaaaggatgaaaacctctatggagaagctctgaagagatgctactgcaccctcgagagagggtacaattcaatgcctataaaccttccaggaacactgttccacaaggccatgaaggcaaggaaagagcttgcacagatcttggctcaaatcatctcaacaaggaggaacatgaagcaagatcacaacaacaacgacttgttgggctcgttcatgagtgaaaaagcaggactcactgatgagcaaatagcagataacatcattggtgctattttcgctgctcgtgacaccactgccactgtacttacttggattgttaagtaccttggtgaaaatccgagtgtcctagaagctgtaactgaagagcaagagtccttattaagaggcaaggaagaaagtggagaaaaaatgggtctgaattggtcagacacaaaaaatatgccagtgacatccagggtgatacaagagactctaagaatagcatcaattttgtcttttactttcagagaagctgtagaggatgttgaatttcaagggtatctcataccaaaaagatggaaagtattacccctttttagaaacatccaccacagtccagacaacttcaaagagccagagaagtttgatccttcaagatttgaggttgctccaaaacccaatacttttatgccatttggcaatgggacacgtgcatgtcctggcaatgaattagccaacttggagattttggtgtttttacatcacctaaccacaaaatacaggtggtctttgatgggtgcaaaaaatgggattcaatatggcccttttgccattccacagaatggattgcccataacactatatcccaaa

SEQ ID NO: 4510 - DNA, 2093 bp, Vigna unguiculata
  misc_feature (22)..(22): n is a, c, g, or t
  misc_feature (64)..(64): n is a, c, g, or t
gacaaccttgcttcgttctctntccgcaacactccattttccttctatagcatgtcgctaagtntaaccatcaagctacacttggcttcatcttcttcctcccacctcaccctcaacacccaccaccaccatgcaaaaaaggtaaaaactttcgaaactttttgctacaacaccaggattcgtcccaaccccatttatagcaccaaccctttgatcatccccgcgtgtagaattaggcagagagtgcagtgtggtgccatggtcaagagttctctgatagagcctgatgggggggcattggtggatcttgtggtgcctgagagtgtgaggagtactaagatcgttgaggccgagacgctgcccaaggtgcagctcacaaggattgatcttgagtgggtgcatgtggtgggggaagggtgggctagtcccttgagagggttcatgagggaggatgagtatcttcagagtttgcatttcaattcccttagggtcaaggatggttctttcgtgaacatgtcccttcccattgtgttggccattgatgacgacaccaaagggagaattgggtcctctacgcatgtggcgttgctggggcctgatggagattttgttgcgattcttcgaagtgttgaaatctacaagcataacaaggaagagagaatagctagaacttggggaaccactgctcctggactaccttatgttgaggaggtcattactcgagctggaaattggcttattggaggagatttggaagtgctgaaacctatcaaatataatgatggtcttgatgactacaggctctctcccaaacaactccgggaagaatttgacaagcgtgaagccgatgcagtttttgccttccagttaagaaaccctgtgcacaatggccatgccttgttgatgaatgatactcgcaaacgccttctggaaatgggctacaaaaatccaattttactgcttcatcctcttggaggattcacaaaggctgatgatgttcccttggatgttaggatggagcaacatagcaaggtcctggaagatggagttcttgatccagagactaccatagttgccatatttccatcgcctatgcattatgctggtccaactgaagtgcagtggcatgccaaggctcgcataaatgcaggtgcaaacttctatattgttggtcgtgatccagcaggtatgggtcacccaactgagaaaagggatttgtatgaccctgatcatggaaagaaggttcttagcatggctcctggtttggagaagcttaacattttgccattcagggtggcagcttatgacaataaggttaataagatggcattttttgacccaacccgtgctaaagattttctctttatttctggaaccaagatgcgggcttttgcgaaaagcggggagaacccaccagatggtttcatgtgtccaagtgggtggaaggttcttgtgaagtactatgaaagtatgcaggcagaagagccatctgagcagcctgtgctatctacctagagataaccagaagtagaagtttagcatgaattgattccgaagggagagtgttaaaaacacagttctgggagtgccaatttttgtgcctggtcttccagcttcatgatgaagatttaatcaatgcgcaagcatatttgaattttttgtactatattgaatcatcattttcttttgaagttactatgactgaggaatttgttgtggtgcatcaagcatgattgcagatgtagtcttctatctgtagactcctgtaagaccagttcaataagggttagggaaattcagcacagcacttggtgcttatgttcattatgggatcaaggttcttaaaatcggttcataagtgcaattgtggttgcaacttcaaggattttgaagtttgtgatcatcgtgatcgtaattgtgactgcattatctgtgtttgtcttcaatttttcacaatattaaggatagtgaccacaatttggatgagttagaaatttgctgagatgtgattactgatatgttaccgtgctgggcaagtgtatcatcaagatgtgatgtgattttatgatagaataaaagtttaataagtttca

SEQ ID NO: 4511 - DNA, 1869 bp, Arachis hypogaea
gcacaaacacaaaaaaggcacaaagataccaacttgggtggctctaacatgtttcccaaatctagaggttcttgttcaactctgttacacaactacttctcttgttctaacataatatattctctctctcacacagtaatctccaacaccaacaacaatgtctctctccattaagttacatgtaacaacttcccatctaaattacctcaaccaccatgccaaaaccaacaccaacactagcacaagtaacattagaaccaaaccaatttacacttccaacccattgatcataacaactagtaggtctagaaaaatgagcttaggctgctatggtgcaccctttattaagagctcattgattgagccagatgggggtgcattggtggaccttgtggtgccagagtctcaaaggggtcctaagattttggaagctgaggcacttccaaaggtaaagctcacaaagattgatatagagtgggtgcatgtgattagtgaaggttgggctagccccttgagagggttcatgagggaagatgagtacttgcaaagccttcatttcaatgctttgaggttgaaaggaaatggatctttggtgaacatgtcactaccaattgtgttggcaattgatgatcagaccaaggagaaaattgggaattcctccaatgttgggttgcttggtcccagtggagattgcattgctattcttagaagcattgaaatctataagcacaacaaggaagaaagaatagctagaacatggggaacaattgctgcagggctgccatatgtagaggaggcgattaccccggccggaaactggcttctcggaggagacttggaagtgctaaagcctatcaagtacaatgatggccttgataactacaggctatctcctaaacaactccgtgaggaattcgaccggcgagaagccgatgcagtttttgcctttcagttaagaaaccctgtacataatggtcatgccttgttaatgaatgatactagaaagggcctattggaaatgggatacaaaaatccaattttgttgcttcatcctcttggtggtttcacaaaagctgatgatgtgcctttgagtgttagaatggaacaacatagcaaggtcttagaagatggagttcttgatcctgagaccaccatagtggctatatttccttcacctatgcactatgccggtccaaccgaggtgcagtggcatgccaaggctaggatcaatgctggtgccaacttctatattgttggccgcgatccagctggcatgggacacccaactgagaaaagggatttatatgatcctgatcatggtaaaaaggtattaagcatggcacctggcctagaaaagcttaatattttgccatttagggtagcagcatatgatactagtgagaataagatggcatttttcgatccctctcgcgccaaggattttctcttcatatccggaacaaagatgagggcttatgcaaaaagtggagagaatccaccagatggttttatgtgtcctaatggatggaaggttcttcttaaatactatgaaagtttgcaaactgaagagtcaccacaacagcctgcagtgttatctgcatagattcacataactgttatgttttgcatttttgttttcatatataaaggaagattctagaagcacagttttaggagtgccttcatgatcaagaaatcatatcatgaatgggcaatcatatttgaattaatatgtgtatcattttgatctttgcaaaaggaattagtactatgcttttagccttttaagaattttgtttgtggtagcttctgtataaaatgagtttgaatttcaaattagttttgcgaaaaaaaagaaaaaaaacaaag

SEQ ID NO: 4512 - DNA, 1855 bp, Medicago truncatula
acatgatcatagaaaaccacttcttgtgaatccaatccaacatgttcgccatagtcataggtggttgttattattattatgtcacattgaaacaattcaacaacattagtactattgtgttctgttcccccacgttcttctcttctctctctccaacaccataaccatcaatttcccataatgtctctaaccattaagttacaattagtttctcatcttaacatcaatcacaacaataaccatgcaaacaaattaatcaaaatcaaaaacaacacttttggtaacactttaaactttcttccaaaacccacttttggtaacaattcattaactgttactaaaaagtctaataataaagttaagagaagaatgcaaggaaatttcatgatcaaaagctctttgatagaaccagatgggggtgtattagtagatcttatggtgcctgaaaatgaaagagagtccaaggtacttgaagctaagtcacttcctaatgtgaaactaacaaaagttgattatgaatgggtgcatgtaattggtgaaggttgggctagtcctttgaaaggtttcatgagggaaaatgaatatcttcaaagtttgcattttaattcacttaggttgaatgatggttcttttgttaatatgtcacttcctattgttttgtctattgatgatgagactaaagagagaattggatcttcttctaatgttgggttgattggacctgatggggatattgttggtattcttagaagcattgaaatctacaagcataacaaagaagaaagaatagctagaacctggggaacaactgctccaggattgccttatgttgaggaggtcattgctccagctggaaattggcttattggaggagatttggaagtgctaaaacctatcaaatacaatgatggtcttgataactacaggctatctcccaagcaacttcgggaagaatttgataggcgtaaagctgatgcagttttcgcctttcagttaagaaatcctgtgcataacggtcatgccttgttaatgaacgatactcgtcaacgtctactagacatgggttacaaaaatccgattttattgcttcatcctcttggaggtttcacaaaggttgacgatgttcccttagatgtcaggatggagcaacatagcaaggttctagaagatggagttcttgatcctgagacgaccatagtttctatatttccatcacctatgcattatgcaggtccaactgaagttcaatggcatgcgaaggcacggataaatgccggcgccaacttctatattgttggtcgcgatcccgctggtatgggtcatccaactgagaaacgggacttgtacgaccctgatcatggaaaaaaggtgcttagcatggctcctggtctcgagaagcttaacattttgccattcagggtggcagcttatgacactaaggtaaacaagatggcatttttcgaccctagccgtgctaaagatttcctctttatatctggaaccaagatgaggtcttatgcaaaaagtggagagaatccaccagatggatttatgtgcccaagtggatggaaagttcttgtcaattattatgaaagtttgcagacagaagaagcatcacaacagcctgtgttatcttcttagacataactacagctactgctagaagtttttgcattaattgattctagaacaagagtgttaagagtaaaacttagggagtgccaatttttatgcatggtcttccaacatcatgagcaagaattcagcaatgcgcaagcatatttgaaatttttgtaacatactgaattatgtttcatttcctaatgagtttaggccttgtttggacatacagttt

SEQ ID NO: 4513 - DNA, 1905 bp, Gossypium hirsutum
acccaaatccgcagttagaacacgaaaaggagtgaaagaggcaaacgtgtggctctcttttccaggccgaacctctttcgccctccaccaccaacgacaacaacgacgaagatgttcgccaattttaaagcttcaagttctgtcctcctgttttcccggatctccctctatttttccaccaacttgttcttcgaatcaactctcacaatccccttccatcatgtctctaacaattaaatctcacttcgcttctcgtacttacctcagcttcaccactaaacccagcagattcacgggttataacactaagatccgaccaaattctatttaccattttaatcctttaagattaacttattaccaacccaaaaaaatgcaagcccccgtccagtattctccagctcccttgatcaagagctcgttgatcgagcctgatggcggggccctcgtcgatctggtagtcccagagggcgaaaggggagcgaagacgattgaggccgagtcattgccgaaggtgaggctaaccaaaatcgacgtggagtgggtgcatgtaatcagcgaaggctgggctaatcctttgaaaggatttatgagggaagatgagtatttgcaaagcttacattttagttctctgagattgaaagatgggtatgttgtcaacatgtcacttcccattgttttggctattgatgatgagactaaggagagaatcgggtcttcttcccatgttgggttggttggacctgatggagacttgatcgccattcttaggagcattgaaatctacaagcataacaaagaagaaagaatagctagaacatggggaacaactgcaccaggtttgccatacgtggaggaagtcattactcctgctggaaactggctcattggaggtgacctagaagttttgaaacctataaaatataatgatgggcttgatcactacagactttcccccaagcaactcagaaaggaattcgataggcgtaatgctgatgctgtttttgcttttcagctaaggaatcctgtgcataatggacatgcactattgatgaatgatactcggagacgacttctagaaatgggtttcaagaatccaatcctcttacttcatcctttaggtggtttcaccaaggctgatgatgtgcccttggatgttcggatggagcaacacagcaaggtcctagaagatggagtccttgaccctgagactaccattgtggccattttcccatcacctatgcattatgcaggtccaacagaggtacagtggcatgccaaggcaaggataaatgctggggctaacttctatattgttggtcgtgatcctgccggaatgggtcacccaacagagaaaagggatctgtatgaccctgatcatgggaaaaaagttctaagcatggctcctggcttggaaaagcttaatattttgccgtttagggttgcggcttatgacatagtggcaaagaagatggcattttttgatccttcgcgtgccaaagatttcctcttcatctctggaaccaagatgcgaacctatgcaagaactggtgagaaccctcccgatggttttatgtgtcctggaggatgggaagtccttgtcaaatactacgagagtttgcaagcagaggaggcaacacagcaaccagctgctgtatcttcttagatgcataatttagtagtagatcttgcagcgagttttattacataacatgtgtggtaggcttgtcctatggtgtcaagttcctaatggcagcagcaccagtaatggattcaacatctccatctctacttttatgcctttgttcaactccctggtgattggagttttgtttttaagcggataatattgtagcaagacaaacaattgatgctggtttgaaatctcattcttttctcaaattt

SEQ ID NO: 4514 - DNA, 1990 bp, Gossypium hirsutum
  misc_feature (688)..(688): n is a, c, g, or t
  misc_feature (902)..(902): n is a, c, g, or t
  misc_feature (1113)..(1113): n is a, c, g, or t
gtgccttttggtgtggtctggtcccctcaacgcccacccaaatccgcagttagaacacgaaaaggagtgaaagaggcaaacgtgtggctctcttttccaggccgaacctctttcgccctccaccaccaacgacaacaacgacgaagatgttcgccaattttaaagcttcaagttctgtcctcctgttttcccggatctccctctatttttccaccaacttgttcttcgaatcaactctcacaatccccttccatcatgtctctaacaattaaatctcacttcgcttctcgtacttacctcagcttcaccactaaacccagcagattcacgggttataacactaagatccgaccaaattctatttaccattttaatcctttaagattaacttattaccaacccaaaaaaatgcaagcccccgtccagtattctccggctcccttgatcaagagctcgttgatcgagcctgatggcggggccctcgtcgatctggttgtcccagagggcgaaaggggagcgaagacgattgaggccgagtcattgccgaaggtgaggctaaccaaaatcgacgtggagtgggtgcatgtaatcagcgaaggctgggctaatcctttgaaaggatttatgagggaagatgagtatttgcaaagcttacattttagttctctgagattgaaagatgggtatnttgtcaacatgtcacttcccattgttttggctattgatgatgagactaaggagagaatcgggtcttcttcccatgttgggttggttggacctgatggagacttgatcgccattcttaggagcattgaaatctacaagcataacaaagaagaaagaatagctagaacatggggaacaactgcaccaggtttgccatacgtggaggaagtcattantcctgctggaaactgtctcattggaggtgacctagaagttttgaaacctgtaaaatataatgatgggcttgatcactacagactttcccccaagcaactcagaaaggaattcgataggcgtaatgctgatgctgtttttgcttttcagctaaggaatcctgtgcataatggacatgcactattgatgaatgatactcggagacgacttctngaaatgggtttcaagaatccaatcctcttacttcatcctttaggtggtttcaccaaggctgatgatgtgcccttggatgttcggatggagcaacacagcaaggtcctagaagatggagtccttgaccctgagactaccattgtggccattttcccatcacctatgcattatgcaggtccaacagaggtacagtggcatgccaaggcaaggataaatgctggggctaacttctatattgttggtcgtgatcctgccggaatgggtcacccaacagagaaaagggatctgtatgaccctgatcatgggaaaaaagttctaagcatggctcctggcttggaaaagcttaatattttgccgtttagggttgcggcttatgacatagtggcaaagaagatggcattttttgatccttcgcgtgccaaagatttcctcttcatctctggaaccaagatgcgaacctatgcaagaactggtgagaaccctcccgatggttttatgtgtcctggaggatgggaagtccttgtcaaatactacgagagtttgcaagcagaggaggcaacacagcaaccagctgctgtatcttcttagatgcataatttagtagtagatcttgcagcgagttttattacatgtgtggtaggcttgtcctatggtgtcaagttcctaatggcagcagcaccagtaatggattcaacatctccatctctacttttatgcctttgttcaactccctggtgattggagttttgtttttaagcggataatattgtagcaagacaaacaattgatgctggtttgaaatctcattcttttctcaaatttgacatttccactttctggtttagttttagagcttctttaatgcttctggtattgg

SEQ ID NO: 4515 - DNA, 2257 bp, Citrus sinensis
  misc_feature (11)..(11): n is a, c, g, or t
  misc_feature (1160)..(1160): n is a, c, g, or t
  misc_feature (1450)..(1450): n is a, c, g, or t
  misc_feature (1881)..(1882): n is a, c, g, or t
  misc_feature (1911)..(1911): n is a, c, g, or t
  misc_feature (1920)..(1920): n is a, c, g, or t
  misc_feature (1940)..(1940): n is a, c, g, or t
  misc_feature (1945)..(1945): n is a, c, g, or t
  misc_feature (1964)..(1964): n is a, c, g, or t
  misc_feature (1967)..(1967): n is a, c, g, or t
  misc_feature (1976)..(1976): n is a, c, g, or t
  misc_feature (1978)..(1978): n is a, c, g, or t
  misc_feature (1980)..(1980): n is a, c, g, or t
  misc_feature (1982)..(1982): n is a, c, g, or t
  misc_feature (1993)..(1993): n is a, c, g, or t
  misc_feature (1997)..(1997): n is a, c, g, or t
  misc_feature (2007)..(2007): n is a, c, g, or t
  misc_feature (2010)..(2010): n is a, c, g, or t
  misc_feature (2013)..(2013): n is a, c, g, or t
  misc_feature (2017)..(2017): n is a, c, g, or t
  misc_feature (2022)..(2022): n is a, c, g, or t
  misc_feature (2025)..(2025): n is a, c, g, or t
  misc_feature (2030)..(2030): n is a, c, g, or t
  misc_feature (2033)..(2033): n is a, c, g, or t
  misc_feature (2037)..(2037): n is a, c, g, or t
  misc_feature (2043)..(2043): n is a, c, g, or t
  misc_feature (2048)..(2048): n is a, c, g, or t
  misc_feature (2050)..(2050): n is a, c, g, or t
  misc_feature (2055)..(2055): n is a, c, g, or t
  misc_feature (2058)..(2059): n is a, c, g, or t
  misc_feature (2068)..(2069): n is a, c, g, or t
  misc_feature (2071)..(2074): n is a, c, g, or t
  misc_feature (2082)..(2082): n is a, c, g, or t
  misc_feature (2087)..(2087): n is a, c, g, or t
  misc_feature (2095)..(2095): n is a, c, g, or t
  misc_feature (2097)..(2097): n is a, c, g, or t
  misc_feature (2100)..(2100): n is a, c, g, or t
  misc_feature (2103)..(2103): n is a, c, g, or t
  misc_feature (2106)..(2106): n is a, c, g, or t
  misc_feature (2109)..(2109): n is a, c, g, or t
  misc_feature (2112)..(2112): n is a, c, g, or t
  misc_feature (2121)..(2123): n is a, c, g, or t
  misc_feature (2125)..(2125): n is a, c, g, or t
  misc_feature (2136)..(2136): n is a, c, g, or t
  misc_feature (2145)..(2145): n is a, c, g, or t
  misc_feature (2147)..(2147): n is a, c, g, or t
  misc_feature (2149)..(2149): n is a, c, g, or t
  misc_feature (2154)..(2154): n is a, c, g, or t
  misc_feature (2162)..(2162): n is a, c, g, or t
  misc_feature (2176)..(2176): n is a, c, g, or t
  misc_feature (2183)..(2183): n is a, c, g, or t
  misc_feature (2187)..(2187): n is a, c, g, or t
  misc_feature (2193)..(2193): n is a, c, g, or t
  misc_feature (2196)..(2196): n is a, c, g, or t
  misc_feature (2201)..(2201): n is a, c, g, or t
  misc_feature (2203)..(2203): n is a, c, g, or t
ccacgcgtccnctttcagctcaccgccgtaggtcgtaatgcgttattataataaatccacttaaaattatgatctttcaaaacgttccacaaattaatagctgcagcagcaacaacaatttcgtcagttacacttgtacttatacataacaaccaccgccatcatgtctctgacgattaaagcacacatcgctgcacactttaacctcaatctccgtacagctaagcagacgaagcttacagattacaacgttaaaatacgaccgaaacccatttaccattcgaatcagttgattgcgtttcagcccaaaatgagtgctgcggtcaaatcagcttcgtctgcgattaagagttctttgatcgagccggatggtggggtcctggtggatctggtggtgccggagagcgaacgggggttgaggacgacggaagccgagtcaatgccgagggtgaagctgacgaagatcgacttggaatgggttcacgtgataagcgagggatgggcgagtccgttgagagggttcatgagggaaaatgagtacttgcagagcttgcattttaattgtttgagaatgaaagatgggtctattgtcaatatgtctcttcctattgttttggccattgatgatgagactaaggagcgaattgggtcttccactaacgtggccttgcttggtcctactggcgacttgatcgggattctcaggagtattgaaatatacaagcataataaagaagagaggatagctaggacttggggaacaactgcagcagggttgccatatgtagaggaggttattaccccggctgggaattggcttgtaggtggagatctggaagtattaaagcccatcaagtacaatgatggtcttgatcactacaggctctctcctcagcaactcaggaaagaattcgataatcgtcaggctgatgcaatttttgcttttcagttaagaaatcctatacataatgggcatgctttgttaatgaacgatacacgcaggcgacttttggaaatgggatacaagaatcctattctgttacttcaccctttaggaggtttcacaaaagctgacgatgtgcccttagatgttcgaatggagcagcacagcaaggtcctagaagatggtgtccttgacccagagacgaccattgtttccntatttccatcacccatgcattatgcaggtccaactgaagttcagtggcatgctaaggcacgtataaatgctggtgctaatttctacattgtaggtcgtgatcctgctggcatgggtcatccaacagagaagagagatttatatgacccagatcatggaaaaaaggtgttaagcatggctcttggtctagagaagctaaatattttgccattcagggttgctgcatatgatactgtggaaaagaaaatggctttttttgatccttcacgtgcaaaagattttctcttcatntctggaaccaagatgcggacttttgcaagaagtggtgagaatcctcctgatggctttatgtgccctgggggatggaaagtccttgtccaatattacgagagcttacaagctgaagaggcaacacagcagccggccattttaacctcttagataaatgatttattgccagagtctcttatcagtagaagaaggaattcgagtaaaagatgaagaggcagagctgaagaccatcttaaagttagtcctagcagctaccacattaggcatatccaagtaatacttgtatgcttaatattcttgttactgtttcgagttaatttttttactacaataaataagagtgcaatgcatgggaattaattgttctagattgtctaaagagactttatatacaagtaaaacatcttgtggattgttttctgcatatgtgnnatgagagcttttgaagttttctttactcntaaaactangaaaggatcttctggcttcngtganaaaaaaaaaaaaaaagggnggnccgctctanangnanccaagcttaantagnggtgcttgcnacntcntagnccttntanagggncancctnaatttnatttncngggcngcnntttttacanngnnnnggacgggnaaaanccccgggngntanccncanttnatncccccttgnnncnccatccccccnttttccccngngnggggnaaaaaaangaaaaaaaggcccnccccccnattncccccnttnccccnanagttttcccccgaccccctgaaagggggaaaaaggggaacagcgccccccggag

SEQ ID NO: 4516 - DNA, 2019 bp, Solanum phureja
tctttctctctcttccttctcactttctcactctactttgctttctccgatggcgcacgatagcgatctcccatgtgacggcgatggcgtctgtatggcctgcaaagtgaagccatcggagaacgaatccctcacctgtaagacttgtgctactccctggcacgtcagctgtctctctgctccgcccgattccatgggcgacgccgtcaactgggagtgtcctgactgctctatgcctcccgccgccgatgttgtacctgttaaacagaatgctgctgcttcttcatcttctggaggaagaggcgatttgatcgctgctattcgggtcattgaatctgattcgactctcaccgagcaagagaaggctcagaaacgacaagacctcatgagcggaaattccaaagacgaaggtgcgactgttgaaggggttaatcaagacaaggatgtgctgaatattctcgattcaagtttgaactgctctatgtgcatgcaactgcctgagagacctgttacgacaccttgtggtcataatttttgcctgaagtgcttccaaaagtgggttgggcagcggaagagtacctgtgctaattgtcgcactcctattccagctaaaatggcaagccagcctcgaattaactctgctctggtcattgccattagaatggcaagaatgatgcggtctggtgcctctagcgggtcatcaaaagtttcacatttcgttcacaaccaaaatagacctgacaaagctttcaccactgagcgtgcaaaaaagactggaaaggctaatgcttgcagtgggaagatttttgttacaatccctggtgaccattttggaccaatttcagcagacaatgatccagagcgcaacgtgggtgttatggttggtgagacttgggaggatcgttttgagtgtcggcaatggggggctcatttccctcatgtggctggtattgcaggacagtcagattatggggcccagtctgttgcactttctggtgggtacgaagatgatgaagatcacggtgaatggtttctctatactggaagtggtggaagagacttgagtggtaacaagagaacaaacaagctacaatcgtttgaccagaaatttgaaaagcttaatgaagctttacgtgtcagctgtctcaagggttatcctgtccgagttgtgaggtcccacaaggagaaatgctcttcgtatgcaccagacaaaggagtacgatatgacggggtctacaggattgaaaagtgttggcggaaacctgggaaacaaggattcaaagtttgtcgatacctttttgtgcgctgtgataatgatcctgcaccatggaccagtgatgaacatggggaccgtcctagggccttgcctgccatcaaagaactaaaaggtgccacagatatgactgagagaaaaggagctccagcctgggattatgatgaggaaaagagttgctggatgtggaaaaaggctcctcctcctagtaggaaaccagttcaatgtgaaaatgaagatggaacaaaaatgagacaagttagaccaaagagacttacaatgtctgtaaagcagaggctcttgaaagagtttacttgtcatctttgtcgggaagtgatgaatcacccgcttaccactccatgtgctcataacttctgcaaggcatgtttggatggtgcctttgcaggtcaatcctttacaagacagaggacatgtgaaggcagacgtacattacgagcccagaaaaatataatgaaatgcccatcatgcccaactgatatatctgatttcctccagagtccccagattaatagagagttgatgaatgtgattgaatctctgaagcgccaaattgaggaagaaaatgcagcattaagtgttgatgttgatgatggtagcttggatggaaacaatgagattatagctgatgaagctgttgaaacagataaaagtgtggaggatgataaagaaggtgcacagcctgtcaatgagactgaaaccaagcagactcacaagaggaagagatc

SEQ ID NO: 4517 - DNA, 1607 bp, Raphanus sativus
  misc_feature (23)..(23): n is a, c, g, or t
  misc_feature (48)..(48): n is a, c, g, or t
  misc_feature (501)..(501): n is a, c, g, or t
  misc_feature (1162)..(1162): n is a, c, g, or t
  misc_feature (1182)..(1182): n is a, c, g, or t
  misc_feature (1298)..(1298): n is a, c, g, or t
  misc_feature (1301)..(1301): n is a, c, g, or t
  misc_feature (1437)..(1437): n is a, c, g, or t
  misc_feature (1454)..(1454): n is a, c, g, or t
  misc_feature (1525)..(1525): n is a, c, g, or t
  misc_feature (1576)..(1576): n is a, c, g, or t
  misc_feature (1587)..(1587): n is a, c, g, or t
ggaacactttcctttgctaaggnaataacgttttattgtcttttccanagtttctcttccacaatccaatttcgatctcttcacagatatcgcagtccgatcttctcgatcactctcgtctcttcgtatcactccaagagagctgagatggaggttgaattcaaggcaatgctcgacgatctcgatgttctcgagaaatctctctccgatcctgctcccatccacaagctgcgatcacatgttgagaatctagcggctctgtccaagtgtaaccctcaccggcgttctaaagtcaaggaattaagttcggaagtggtagatagtaatccttacagtaggcttatggcacttcagcggatgggtattgtggagaactatgagaggatcagagagttctcagtcgccattgttgggattggtggtgttggaagtgttgctgctgaaatgctgacaagatgtggtataggtcgtcttttgttgtatgactatgacactgtcganctagctaacatgaacagactctttttccgacctgatcaggttggtatgacaaagactgatgctgctgttcagacgcttgctgaaattaaccctgacgtagtacttgagagtttcacaatgaacataacaacagtgcaaggctttgaaaccttcacgtccagcttgaagaacaagtcgttttgtcctagcaaggagggaagtggtgtggatcttgttttgagttgtgtcgataattatgaagcaaggatggctgtcaaccaggcatgcaatgagttacgtcagacatggatggagtcaggtgtttctgaagatgccgtttcaggtcacatacagcttctggttcccggagaaactgcttgttttgcttgtgcacctcctctggtcgtggcatctggaatagatgaacggacactaaagagagaaggagtctgtgctgcttctctgcctactactatgggtgttgttgcggggcttttggttcaaaactctctcaagttcttactaaattttggtgaagtttctccatacttgggttacaattcactgaaggattttttcccaaccatgcaaatgagaccaaatccacagtgctcgaatgtagcttgtatggaacggcagaaagaatacatgcttgcaaaaccagcaagggacgctgctgccnaagccaagatggaagctgangcgttaacagctattgatgatggcccactccatgatgatatgagtggaacataagtgtggttgacgatgaaaatgagaaggataccgcaaaagcttcctcaagttcagatacattnccngaagggcttactagggagctgccagtcgcagatgagtatgagaaggcaatagctatagggtctggagaggcagaggaggaagaggacgaccttgaagatctcaaaaagcagctcgaagctcttaatgctgcttganggtctttatggggtaanagacagactaaagttccttagcagttttttttttacttgaaagaggcgacaaatgcaattgtgtgaaaagnaaagtgtttgatgtttgataaattggatctcataggcatatataaactatnaacttttttgnatgatgaattctccctttta

SEQ ID NO: 4518 - DNA, 1649 bp, Brassica napus
  misc_feature (313)..(313): n is a, c, g, or t
  misc_feature (394)..(394): n is a, c, g, or t
  misc_feature (427)..(427): n is a, c, g, or t
  misc_feature (658)..(658): n is a, c, g, or t
  misc_feature (673)..(673): n is a, c, g, or t
  misc_feature (703)..(703): n is a, c, g, or t
  misc_feature (1105)..(1105): n is a, c, g, or t
  misc_feature (1627)..(1628): n is a, c, g, or t
  misc_feature (1640)..(1640): n is a, c, g, or t
  misc_feature (1647)..(1649): n is a, c, g, or t
ttgaggacccagctgcctgatagagggcagccggcagggtcggcccggaatccggggtgacggccattacggccgggggtttaaaaaagttaaaaaaccttgtccaactccagagtttctcttccaaatcccttctatttctcaaacgagcatcgcagatttcgtagtgctcatggaggttgaattgaaagcattgctcgatgatctcaacgttctcgagaaatctctctccgatccggctccgatccagaagctgcgatcacatgttgagaatctagcggctctgtctaagtgtaaccctcaccggcgttcnaaagtcaaggaattgagttcggaagtggtagatagtaatccttacagtaggcttatggctcttcagcggatgggtattgtngagaactatgagagaatcagagagttttcagtngccattgttggcattggaggtgttggaagtgttgctgctgaaatgctgactagatgtggtattggtcggcttttgttgtatgactatgacactgtcgaacttgctaacatgaaccgactctttttccgacctgatcaggttggtatgacaaagactgatgctgctgtacagacccttgcagaaattaaccctgacgtagtccttgagagtttcacaatgaacataacaacngtgcaaggctttganaccttcacgtcgagcttgaagaacaagtcnttttgtcctaccaaggagggcagtggcgtggatcttgttttgagttgtgtcgataattatgaagcaaggatggctgtcaaccaggcatgcaatgagttaaatcagacatggatggagtcaggtgtttccgaagatgctgtttcaggtcacatacagcttctggttcctggagaaactgcttgttttgcttgtgcacctcctctggtcgttgcatctggaattgatgaacgaacgcttaagagggaaggggtctgtgctgcatctcttcctactactatgggtgttgttgctggtcttttggttcaaaactctctcaagttcttactgaattttggtgaagtttctccatacctgggttacaattcactgaaggattttttcccaaccatgcaaatgagaccnaatccacaatgctcgaatgcagcttgtctagaacggcagaaggagtacatgcttgcgaaaccagcaagggacgctgctgctaaagctaagatggaagccgaagcagcaacagctgtagatgatggcccactccatgatgataacgagtggaacataagtgtggtcgatgatgaaaatgagaaggatactacaaaagcttcctcaagttcaggtgcattgccagaagggcttactcgggagcttccagaggcagatgagtatgagaaagcaatcgctatagggtctggagagacagatgaggaggaggacgaccttgaggatctgaagaaacagctcgaggctcttaatgctgcctgagtctttgtggtatagttgtttagcagtttttttacttgaaagaggcggcaaatgcaattgtgtaaaccataaacgagtgtgttggagttttgataaattggatctcatgggcatataaactttacttgaataccttttggatgatgattctctccctttatcatnngcaccaaagcgnagagatnnn

SEQ ID NO: 4519 - DNA, 1647 bp, Brassica napus
tagaggtcatggtatcgatagttgatatcaatacgtatcggcattacggccggggatgttacagagtatctcttccacaatccaattcgatctcttcgcagattccgcactccgatcttctccatcactctcgttctctccgtatcgtttccaagagagccgagatggaggttgaattcaaagcaatgctcgacgatctcgatgctctcgagaaatctctctccgatcctgctcccatccacaagctgcgatcacatgttgagaatctagcggctctgtccaagtgtagccctcaccggcgttccaaagtcaaggagttaagttcggaagtggtggatagtaatccttacagtaggcttatggcacttcagcggatgggtattgtggagaactatgagaggatcagagagttttcagtcgctattgttggaattggtggtgttggaagtgtggctgctgagatgctgaccagatgtggtataggtcgtcttttgttgtatgactatgacactgtcgagctagctaacatgaacagactctttttccgacctgatcaggttggtatgacaaagactgatgctgctgttcagacgcttgctgaaattaaccccgacgtagtacttgagagtttcacaatgaacataacaacagtgcaaggctttgaaaccttcacgtcgagcttgaagaacaagtcgttttgtcctaacaaggagggcagtggcgtggatcttgttttgagttgtgtcgataattatgaagcaaggatggctgtcaaccaggcatgcaatgagttaaatcagacatggatggagtcaggtgtttccgaagatgctgtttcaggtcacatacagcttctggttcctggagaaactgcttgttttgcttgtgcacctcctttggtcgttgcatctggaattgatgaacgaacgcttaagagggaaggggtctgtgctgcatctcttcccactacaatgggtgttgttgctggtcttttggttcaaaactctctcaagttcttactgaattttggtgaagtttctccatacctgggttacaactcactgaaggattttttcccaactatgcaaatgagacctaatccacaatgctcgaatgcagcttgtctagaacggcagaaggagtacatgcttgcgaaaccagcaagggacgctgctgctaaagctaagatggaagccgaagcagcaacagctgtagatgatggcccactccatgatgataacgagtggaacataagtgtggtcgatgatgaaaatgagaaggatactacaaaagcttcctcaagttcaggtgcattgccagaagggcttactcgggagcttccagaggcagatgagtatgagaaagcaatcgctatagggtctggagagacagatgaggaggaggacgaccttgaggatctgaagaaacagctcgaggctcttaatgctgcctgagtctttgtggtatagttgtttagcagtttttttacttgaaagaggcggcaaatgcaattgtgtaaaccataaacgagtgtgttggagttttgataaattggatctcatgggcatataaactttacttgaataccttttggatgatgatttctctccctttttatctattggctaccaaagacgaagagatacc

SEQ ID NO: 4520 - DNA, 1654 bp, Brassica napus
ttgaggacccagctgcctgatagagggcagccggcagggtcggcccggaatccggggtgacggccattacggccgggggtttaaaaaagttaaaaaaccttgtccaactccagagtttctcttccaaatcccttctatttctcaaacgagcatcgcagatttcgtagtgctcatggaggttgaattgaaagcattgctcgatgatctcaacgttctcgagaaatctctctccgatccggctccgatccagaagctgcgatcacatgttgagaatctagcggctctgtctaagtgtaaccctcaccggcgttccaaagtcaaggaattgagttcggaagtggtagatagtaatccttacagtaggcttatggctcttcagcggatgggtattgtcgagaactatgagagaatcagagagttttcagtcgccattgttggcattggaggtgttggaagtgttgctgctgaaatgctgactagatgtggtattggtcggcttttgttgtatgactatgacactgtcgaacttgctaacatgaaccgactctttttccgacctgatcaggttggtatgacaaagactgatgctgctgtacagacccttgcagaaattaaccctgacgtagtccttgagagtttcacaatgaacataacaacggtgcaaggctttgagaccttcacgtcgagcttgaagaacaagtcattttgtcctaccaaggagggctgtggcgtggatcttgttttgagctgtgttgataattatgaagcaaggatggctgtcaaccaggcatgcaacgagttaagtcaaacgtggatggagtcaggtgtttctgaagatgccgtttcaggtcacatacagcttctggttcctggagaaactgcttgttttgcctgagacctcctccggtcgtggcatctggaattgatgaacggacacttaagcgagaaggggtctgtgctgcatctctgcctactactatgggtgttgttgcggggcttttggttcaaaactctctcaagttcttactaaactttggtgaagtttctccatacttgggttacaattcactgaaggattttttcccaaccatgcaaatgagaccaaatccacaatgctctaacgcagcttgtatggaacggcagaaagagtacatgcttgcaaaaccagcaagggacgctgctgccaaagctaagatggaagctgatgcgttaacagctgttgatgatggtccactccatgatgataatgagtggaacataagtgtggttgatgatgaaaatgagaaggatgcagcaaaagcttcctcaagttcagatacattgccagaagggcttactagggagcttccagtcgcagatgagtatgagaaggcaatagctatagggtctggagaggcagaggaggaagaggacgaccttgaagatctgaagaagcagctcgaagctcttaatgctgcttgaagtcttttattgtgagacataatatagttgttttatcagtttttacttgaaagaggtgacaaacgcaattgtgtaaaagcaaaagaaaagagtgtttgaggttttgataaattggatctcacaggcatataaacaataatctttttggataaaaaaaaaaaaaaaaaactcgagactcagttctctcgagaag

SEQ ID NO: 4521 - DNA, 1394 bp, Carica papaya
agtgttattagattcagacaaagcacgaacagattcagagctacagagacagggagttcagagtagagactggcaatggaggcggaattgaatggattgcttcatgatctcgattctctcaagcaatcactgcatgatccttcttcccttgcttctctcgacaagctgcgatcacgagttgagcatgtcacaaaccttgccaagtcggcagctgttcgccgttcaaaagtcaaggatatgagtgctgaggtggtcgatagtaatccttacagtaggcttatggcgcttcagaggatgggtattgtggagaactatgaaagaattagagagttctcagttgccatagttggaattggtggtgtgggaagtgttgcagctgagatgctgactagatgtggcattggccgccttttgttgtatgactatgacaaagtggagctggcaaacatgaacagattgttttttcgtccggatcaggttggcatgacaaagaccgatgctgctgttcagactctttcagacataaatcccgatgtggtgctagagagctatacgctgaacatcacaacagttcaaggttttgagacctttatgtcaagtttaagaaacaaatcttttcgccccagcaaagaaggtagtggagtggatcttgtattaagctgtgtagataactacgaagccaggatggctgtcaaccaggcctgcaatgagttgaatcagacatggatggagtctggtgtatccgaagatgcggtttcaggtcatatacaattgctggttcctggagaaactgcttgttttgcatgtgcacctcctctggttgtggcatctggagtagatgaacggacactcaagcgggagggagtttgtgcagcatctttaccgactacgatgggagtggttgctgggcttttagttcaaaatacactgaagttcttgctaagttttggatacgtttccccctacttgggctataattctcttaaagattatttcccgactatgcaaatgaagccaaatccacaatgctccaatgtggcttgtctgcagcggcagaatgactatattcttgcaaagccggccagggatgctgcagctaaagccaagatgcaagctgaagcatccacaagtgtagaaggtcctcttcatttcgataatgaatggaacataagtgttgttgatgatagcgaggtggatacaacaggtgccacaagttcagacaatctcccagaaggtcttacccgtgagctcccaagtgcagatgaatatcagaaacttccagttcctgcagagatagcttctattgatgaccttgatgatcttcggaggcaacttgaggctcttaatgcttgattaatagcggctctcttttttccagagaaagatggtagagt

SEQ ID NO: 4522 - DNA, 1760 bp, Ricinus communis
aacgaattttgaggcaaacaagacaacgatcgcagtgatatagctgactagcagcagcagcaagaaactgcaagcagcaatggaggctgaattgaaaggcctgctagatgatctctcatctctcatttcttcgctgcctgatgcttctcgtcaggcatcgattcacaagctgcaatcgcgtgttgaagttatcacgaagctggcaacttctgctccgtctcggcgttcaaaagtcaaggatatgagtgcagaggtagttgatagcaatccgtatagtaggctaatggcgcttcaaagaatgggcattgtgcacaactatgagagaattcgggagttctctgttgccattgttggaattggtggtgttggtagtgttgcagctgagatgctaacaagatgtggcataggtcgacttttattgtatgattatgacaaagtggagttggccaacatgaataggcttttctttcgtccggatcaggttggcatgacaaagactgatgctgccgttcagacactttcagaaataaatcctgatgttgtgcttgagagctatacgatgaacatcacaacagtacaaggatttgaaacctttgtgtcaagtttgaaaagtaaatcatttcgcccaagtaaagaaggtactggagtagatcttgttttaagctgtgtggataattatgaagcaaggatggctgttaaccaggcctgtaatgagttgaaccagacatggatggagtctggtgtatctgaagatgctgtctcgggtcatatacaactattgattcctggagaaactgcctgttttgcatgtgctcctcctctggttgtggcatctggtgtagatgagcggacactcaagcgtgagggggtttgtgcagcatctttgcctaccacaatgggagttgttgcagggcttttagtacaaaatacattaaagttcttgttacaatttggacatgtatccccatatcttggatacaattctctaaaagactatttcccaacgatggaaatgaagccaaatccacaatgttcaaatgcagcttgtttggagcgtcagaaagaatacattattgcaaagccggctagggatgctgcagctaaagccaagatggaggcagaagcatcattagctacagaaatcccacttcatactgataatgaatggaatataagtgttgttgatgatagtgagccggaaacaaaagatgccacaagttcagcagataagcttccagaaggtcttgctcgggagctcccaactgcagatgaatttcaaaagttcccagctgctgagacgtctacaactacatttgatgaccttgaagaactcaagaagcaacttgaagccctcaatactgattaaggactgcgttgatattgatattttgttgcctctctggatgaaaaaatcaaagctctcactggagtaatccggtcatgcttacccataagttaacaaaacaaactaccaatacaaaaccttcatgctttgttctttttctatcatatttcactgtatcttttaaaaaatgtagcctgattcaactttagcttcttattttttttttgcttttagattgttttactttcctaatacttcgatctcttttccaagttcttacaaagctagattttcatgtatgcacatacttttttggtcaacgtgaatgcatttactcattctaatgcgacaaaataattaattccattacattttttaatcaagtctgtcactctttctattagccattagcttt

SEQ ID NO: 4523 - DNA, 771 bp, Raphanus sativus
acgattccaattattgaactctctctaatttacttgaatcaccaaaaaaaaaaaaagtctttctagaagtcatttttactttctaccaccaccacctttttgtgtcttcaaaacatgactattgctttaacgatcggaggaaacgggttctcgggtttatccggatcttccttttcatcatcttcttcatcgtttcgactgaagaacagcagaagaaaagacacgaagatgcttaacagaacacgagtcgtctgttcttcgtcttcagtaatggatccttataaaacacttcagatccgacccgattcatcggaatacgaggtcaagcaagctttcagacaactcgccaaaaagtatcatcctgatgtttgtagaggaagcaactgtggagtacagtttcagacaatcaacgaagcttacgatattgtgttgaagcaaataaagaatcagatggagggaacagaggaatttgagccatttgatgtgtatgacgagggattcaacggaatgaatgatccagattgtgacacgtgggaagaatggatgggatgggaaggtgcaggaaccagagactactcctctcacgtcaatccttacgcttgaagaagatgattcgaaggcatataaataaccaacatagagactgatgtaaatacatgaaactgtctcgtgaataaaaatgtaaataaaaagtcatttctctctgtcattgtaaatctcaaccttaagcttaaatgaaaatcatctcaatataactccaaaaagataaga

SEQ ID NO: 4524 - DNA, 1416 bp, Raphanus sativus
  misc_feature (126)..(126): n is a, c, g, or t
  misc_feature (184)..(184): n is a, c, g, or t
  misc_feature (222)..(222): n is a, c, g, or t
  misc_feature (253)..(253): n is a, c, g, or t
  misc_feature (465)..(465): n is a, c, g, or t
  misc_feature (574)..(574): n is a, c, g, or t
  misc_feature (586)..(586): n is a, c, g, or t
caggccgttacagcacaataagtggtcaaatgggaaagacgggtttcttgtaaccgatatctggggcaaagatgcgacgccaacgatctggctgcggcagacacaggagagagttcaccttttagnttatcaacacaaatgtctcaccttggttcttctggtgcctaccatggccattgttaanggagagctagacatctcattcgtgaagcaccaagttantgaaaacgcatcggcgaaaatcttgaaggtngaagagaagctgtcaaaaggatggggcggtgagaacgcttaccatgttagcggttaccgttacttgctagttgataatgacacggaagtttccagagcttctccgtccggaaaggtagcaacgttagcgaaggagacgttacttgcagtaaacaagctaagggaaacagtggacgcagaaaagagccgcacgaaggaagagaaagacatggngatatgcatcagagcgaagaacaacgcgtgggccatcgctcgtctgacgagagggaaagagctttacatggctttagagaaagcaagtgacactcttcttgatgctacngactctgtccanagtttcagcaacaggtactgcaacggaacattctccatggactagaactctgtaatctttttggagttatattgagatgattttcatttaagcttaacgttgagatacaatgaaggagagaaatgacttttatttacattttaagtaaccattcacgagacagtttcatgtatttacatcgttcagtctctatgttgttatttatgtgcgttcgaatcatttcttcttcaagcgtaaggattgacgtgagaggagtagtctctggttcctgcaccttcccatcccatccattcttcccacgtgtcacaatctggatcattcattccgttgaatccctcgtcatacacatcaaatggctcaaattcctctgttccctccatctgattctttatttgcttcaacacaatatcgtaagcttcgttgattgtctgaaactgtactccacagttgcttcctctacaaacatcaggatgatactttttggcgagttgtctgaaagcttgcttgacctcgtattccgatgaatcgggtcggatctgaagtgttttataaggatccattactgaagacgaagaacagacgactcgtgttctgttaagcatcttcgtgtcttttcttctgctgttcttcagtcgaaacgatgaagaagatgatgaaaacgaagatccggataaacccgagaacccgtttcctccgatcgttaaagcaatagtcatgttttgaagacacaaaaaggtggtggtggtagaaagtaaaaatgacttctagaaagactttttttttttttggtgattcaagtaaattagagagagttcaataattggaatcgt

SEQ ID NO: 4525 - DNA, 773 bp, Raphanus sativus
ggccaactcaaaccacgattccaattattgaactctctctaatttactttaatcaccaaaaaaaaagtctttctagaagtcatttttactttctaccaccaccttttgtgtcttgaaaacatgactattgctttaactatcggaggaaacgggttctcgggtttatccggatcttccttttcatcatcttcttcatcgtttcgactgaagaacagcagaagaaaagacacgaagatgcttaacagaacacgagtcgtctgttcttcatcttcagtaatggatccttataaaacactacagatccgacccgattcatcagaatacgaggtcaagcaagctttcagacaactcgccaaaaagtatcatcctgatgtttgtagaggaagcaactgtggagtacagtttcagacaatcaacgaagcttacgatattgtgttgaagcaaataaagaatcagatggagggaacagaggaatttgagccattcgatgtgtacgaagagggattcaacggaatgaatgatccagattgtgacacgtgggaagaatggatggggtgggaaggtgcaggaaccagagactactcctctcacgtcaatccttacgcttgatgaagaagtaatgattcaaatgcacataaataacaacatagagactgaacgatgtaaatacatgaaactgtctcgtgaatggtacttaaaatgtaaataaaagtcatttctctccttcattgtaaatctcaacgttaaagcttaaatgaaaatcatctcaatat

SEQ ID NO: 4526 - DNA, 1737 bp, Brassica oleracea
  misc_feature (1726)..(1726): n is a, c, g, or t
tcttgtgggagtgctggattcatgtgctgggacgctacgatgccactctgtgattctatttcacgacctacttgtgtcaacaactctatcacctgatgataccgtcgacttgtttacattctctgtaatgagattgacctcaaacgcgctatcttccggcacgagttcctggtcatatctacgcaagggaaccagcttatcacaaacctcttctaaatctacctcaccgcaacttcttgtttcaagtgattcactgccttcaggaaacggtcatgacgcaggtcgtgttattaggccgttacagcacaataagtggattaaaaagggaaagatgtttcttgtaaccgatatctggggtaaagacgcgacaccaacgatctggctacatcagagacaagagagagttcaccttttagcatatcaacaaaaatgtctcaccttggttcttctcgtgcctaccgaggccattgttaatggagagctggacatctcgttcgtgaagcaccaagttattgaaaacgcaactgcgaaaatcttgaaggtcgaagagaagctgtctaaaggatggggaggggagaacgcttaccatgttagcggttaccgttacttgctagttgataatgacatggaagtttccagagcttctccttcggggaaggtagcaacgttagcaaaggagactttacttgcagtaaacaagctaagggagacggtggatacagaaaagagccgtacgaaggaagagaaagacatggagatatgcatcagggcaaagaacaacgcgtgggccatcgcacgtgtaacgagaggtaaagagctttacatggctttggagaaagccagtgacactcttcttgatgctacagactctgtccaaagttttagcaacaggtattgcaacggaacattctctatggactagagctctgcaatctttttttaattactctcgagataattttcattaagcttatcgttgagatttacatgatgaaagagagataacttttatttacatcttaagtatcattcacgagacagtttccatgtatttacatcgttctttatagcagtctcagttgttatttatatgcactcgaatcatgtcttcttcatctttcttcaagcgtaaggattgacatgagaggagtagtctctggtccctgcaccttcccatcccatccattcttcccacgtgtcgcaatctggatcattcattccgttgaatccctcatcatacacatcgaatggctgaaactcctctgttccctccatctgattctttatttgcttcaacacaatatcgtaagcttcgttgattgtctgaaactgtaccccgcagttgcttcctctgcaaacatcaggatgatactttttggcgagttgtctgaaagcttgcttgacctcgtattctgatgaatcgggtcggatcttcagggtcttgtacggatccattactgaagatgaagaacagacgactcctgttctgttcagcatcttcgtgtcttttcttttgctgttctttaaccgaaacgatgaagaagaagaagaaaacgaagatccggatagacccgagaacccgtttcctccgatcgttaaagcaatagtcatgtttttcaaattatcaagatacaaaggtggtagaaagtaaaaatgatttctagaaagcaaaaaccagattctttttttttgtgtgattaaagtaaattagagaggttcaataatnggacgcgtggg

SEQ ID NO: 4527 - DNA, 2475 bp, Brassica napus
  misc_feature (1291)..(1291): n is a, c, g, or t
  misc_feature (1651)..(1651): n is a, c, g, or t
  misc_feature (1653)..(1654): n is a, c, g, or t
  misc_feature (1657)..(1657): n is a, c, g, or t
ggctataacgagtttcgattagcagatctaagtcctttatcatcttaaatttcttcttttttggtttgtttgtgattcttgttctgtaattggaggtcgttcagagcttggactttgttgttagggttcatctctcaaggggttttatgagatcttagaagctatgggaatggcgtccatgaactctagtggcgaaagccttaaactttgcgtgttcgacttgaggagaggacaaaacgaaggacaggagcttgacaagatcttgttcttctaccctcctgatgtaaccttctccactcagctctctgttatcggcctcagcgaagggcttatcacctttactagacttttctccccagaggcagcttgtgaggttatagaagcagagagacattctcatgttttccatgaagccgagcctgatatatggatggtcatggttgtagagaaaaataaggagattgaagccatatggagggtagatgcattgcagaaggtgctaaaggaagtccattccctctttgttatgttccacggatcagttaggtcattgcttgataaagaaccatctggtgggcttatacgatctcacttgtatcccttcatcacagactatttaaatgatctttctgttgggaagaaacttcagttgccttccttccgtgaaactttgaaagagcgtggtacagttcagatgcttactttagcaagggacgcggcacttgaagttcagtctcttgttggggtgctggattcatgtgctgggacccttcgatgccactctgtgcttctgtatcatgacctacttgtgtcaacaactctatcacctgatgatactgtcgacttgtttacatactctgtcatgagattgacctcaaacgcgctatcttctggcacgagttcctggtcatatctacgcaagggaaccagcttatcccaaacctcttctagatctatctcaccacaacttcttggttcaagtgattcactgccttcaaacggtaatgacgcaggtcgtgttatcaggccattgcagcacaacaagtggtcaaaagggaaagacgggtttcttgtaaccgatatatggggtaaagacgcgacaccgacgatctggctacatcagagacaagagagagttcaccttttagcctatcaacacaaatgtctcaccttggttcttctcgtgcctaccgaggccattgttaatggagagctagacatctcattcgtgaagcaccaagttactgaaaacggaactgcgaaaatcttgaaagtggaagagaagctgtcnaaaggttggggaggtgagaacgcttaccatgtaagcggttaccgttacttgctagttgataatgatatggaagtttccagagcttcaccgtcgggaaaggtagcaacgttagcgaaggagactttacttgcagtaaacaagctaagggaaacagtggatacagaaaagagtcgcacgaaggaagagaaagacatggagatatgcatcagagcaaagaacaacgcgtgggccatcgcacgtgtaacgagaggtaaagagctttacatggctttagagaaagcaagtgacactcttcttgacgctacagactctgtccaaagttttagcaacaggtactgcaacggaacattctctatggantnnagntctgcaatcttttttaattactctcgagataattttcattaagcttatcgttgagatttacatgatgaaagagagataacttttatttacatcttaagtatcattcacgagacagtttccatgtatttacatcgttctttataacagtctcagttgttatttatgcgcactcgaatcatttattcatcttcctcaagcgtaaggattgacgtgagaggagtagtctctggtccctgcaccttcccatcccatccattcctcccacgtgtcgcaatctggatcattcattccgttgaatccctcatcatacacatcgaatggctgaaactcctctgttccctccatctgattctttatttgcttcaacacaatatcgtaagcttcgttgattgtctgaaactgtaccccacagttgcttcctctgcaaacatcaggatgatactttttggcgagttgtctgaaagcttgcttgacctcgtattctgatgaatcgggtcggatcttaagggtcttgtacggatccatcacagaagaggaagaacagacgactcctgttctgttcagcatcttcgtgtcttttcttttgctgttctttaatcgaaacgatgaagaagaagatgaaaacgaagatccggatagacccgagaacccgtttcctccgatcgttaaagcaatagtcatgttttttcaaattttcaagatacaaggtggtagaaagtaaaaatgatttctagaaagcaaaaaccagattctttttttttttgtgtgattaaagtaaattagagaggttcaataattggaatcgttgattgggttcc

SEQ ID NO: 4528 - DNA, 797 bp, Brassica napus
ggaacccaatcaacgattccaattattgaacctctctaatttactttaatcacacaaaaaaaaaaagaatctggtttttgctttctagaaatcatttttactttctaccaccttgtatcttgaaaatttgaaaaaacatgactattgctttaacgatcggaggaaacgggttctcgggtctatccggatcttcgttttcatcttcttcttcatcgtttcgattaaagaacagcaaaagaaaagacacgaagatgctgaacagaacaggagtcgtctgttcttcctcttctgtgatggatccgtacaagacccttaagatccgacccgattcatcagaatacgaggtcaagcaagctttcagacaactcgccaaaaagtatcatcctgatgtttgcagaggaagcaactgtggggtacagtttcagacaatcaacgaagcttacgatattgtgttgaagcaaataaagaatcagatggagggaacagaggagtttcagccattcgatgtgtatgatgagggattcaacggaatgaatgatccagattgcgacacgtgggaggaatggatgggatgggaaggtgcagggaccagagactactcctctcacgtcaatccttacgcttgaggaagatgaataaatgattcgagtgcgcataaataacaactgagactgttataaagaacgatgtaaatacatggaaactgtctcgtgaatgatacttaagatgtaaataaaagttatctctctttcatcatgtaaatctcaacgataagcttaatgaaaattatctcgaga

SEQ ID NO: 4529 - DNA, 804 bp, Brassica napus
caatccacgattccaattattgaacctctataattttactttaatcacaaaaaaaaaaaaaaaagaatctggtttttgctttgtagaaatcattttactttctaccaactcgaatcttgaaaatttgaaaaacatgactattgctttaacgatcggaggaaatggattctcgggtctatccggatcttcgttttcatcatcttcttcatcttttcggttaaagaacagcagaagaaaagacacgaagatgctgaacagaacaggagtcgtctgttcttcatcttctgtaatggatccgtacaagacccttaagatccgacccgattcatcagaatacgaggtcaagcaagctttcagacaactcgccaaaaagtatcatcctgatgtttgcagaggaagcaactgtggagtacagtttcagacaatcaacgaagcttacaatattgtgttgaagcaaataaagaatcagatggagggaacagaggagtttcagccattcgatgtgtatgacgagggattcaacggaatgaatgatccagattgcgacacgtgggaggaatggatgggatgggaaggtgcagggaccagagactactcctctcacgtcaatccttacgcttgaagaagatgaacaaatgattcgaatgcacataaataacaactgagactgctataatgaacgatgtaaatacatgaaactgtctcgtgaatgatacttaaattgtaaataaaagtaatctatccttcatcatgtaaatctcaacgctaagcttgacagaaattatgtcaaagtagttaaaaaag

SEQ ID NO: 4530 - DNA, 776 bp, Raphanus sativus
ggccaactcaatacacgattccaattattgaactctctaatttactttattcaccaaaaaaaagtctttcaagaagtcacttttactttctaccaccaccttttgtgtcttgaaaacatgactattgctttaacgatcggaggaaacgggttctcgggtttaaccggatcttcgttttcatcatcttcttcatcgtttcgactgaagaacagcagaagaaaagacacgaagatgcttaacagaacacgagtcgtctgttcctcgtcttcagtaatggattcttataaaacacttcagatccgacccgattcatcagaatacgaggtcaagcaagctttcagacaactcgccaaaaagtatcatcctgatgtttgcagaggaagcaactgtggagtacagtttcagacaatcaacgaagcttacgatattgtgttgaagcaaataaagaatcagatggagggaacagaggagtttgagccattcgatgtgtatgacgagggattcaacggaatgaatgatccagactgtgacacgtgggaagaatggatggggtgggaaggtgcaggaaccagagactactcctctcacgtcaatccttacgcttgaagatgaagtaatgattcgaatgcacataaataacaacatagagactgatgtaaataaatacatgaaactgtctcgtggatggtacttaaaatgtaaataaaaagtcatttctctccttcattgtaaattcaacgttaagcttaaatgaaaatcatctcaatataactcca

SEQ ID NO: 4531 - DNA, 773 bp, Raphanus sativus
  misc_feature (314)..(314): n is a, c, g, or t
  misc_feature (395)..(395): n is a, c, g, or t
  misc_feature (609)..(609): n is a, c, g, or t
acgattccaattattgaacctctctaatttacttgaatcaccaaaaaaaagtctttctagaagtcatttttactttctaccaccaccacctttttgtgtcttgaaaagatgactattgctttaacgatcggaggaaacgggttctcgggtttatccggatcctccttttcatcatcttcttcatcgtttcgactgaagaacagcagaagaaaagacacgaagatgcttaacagaacacgagtcgtctgttcttcatcttcagtaatggatccttataaaacacttcagatccgacccgattcatcagaatacgnggtcaagcaagctttcagacaactcgccaaaaagtatcatcctgatgtttgtagaggaagcaactgtggagtacagtttcngacaatcaacgaagcttacgatattgtgttgaagcaaataaagaatcagatggagggaacagaggaatttgagccatttgatgtgtatgacgagggattcaacggaatgaatgatccagattgtgacacgtgggaagaatggatgggctgggaaggtgcaggaaccagagactactcctctcacgtcaatccttacgcttgaagatgaagtaangattcgaatgcacataaataaccaacatagagactgaacgatgtaaatacatgataaactgtctcgtgaatggttacttaaaatgtaaataaaaaagtcatttctctccttcattgtaaatctcaaccttaagcttaaatgaaaatcatctcaatataactcca

SEQ ID NO: 4532 - DNA, 813 bp, Brassica rapa
aactcaatccacgattccaattattgaacctctctaatttactttaatcacacaaaaaaaaaagaatctggtttttgctttgtagaaatcattttactttctaccaccttgtatctagaaaatttgaaaaacatgactattgctttaacgatcggaggaaatggattctcgggtctatccggatcttcgttttcatcatcttcttcatcttttcggttaaagaacagcagaagaaaagacacgaagatgctgaacagaacaggagtcgtctgttcttcatcttctgtcatggatccgtacaagacccttaagatccgacccgattcatcagaatacgaggttaagcaagctttcagacaactcgccaaaaagtatcatcctgatgtttgcagaggaagcaactgtggggtagagtttcagacaatcaacgaagcttacaatattgtgttgaagcaaataaagaatcagatggagggaacagaggagtttcagccattcgatgtgtatgatgagggattcaacggaatgaatgatccagattgcgacacgtgggaggaatggatgggatgggaaggtgcagggaccagagactactcctctcacgtcaatccttacgcttaaagttgaggaaatgattcgaatgcacataaatgacaacatagagactataaggaacgatgtaaatacatgaaactgtctcgtgaacggtacttaagatgtaaataaaaagttatctctctttcatcatgtaaatctcagcgttaagcttaatgaaaattatctcaacgtaattaaaaaagattgcacaacttt

SEQ ID NO: 4533 - DNA, 771 bp, Thellungiella halophila
cggccatcacgaatccacaaatccaattattgaaccttcaaatttacttcaatcacaaaaaaaaaacttgtccactttttgttttccgggaaatcatataaccgctaaagtgaaaaaaatatgactattgctttaacgatcggaggaaacggcttctcgggtttacccggatcgtcgttctcatcatcttcttcatcatttcgattaaaaaacagcagaagaaagaacacgaagatgctgagcaggacaggagtcatttgttcttcatcttctgtaatggatccgtataagacccttatgatccgacccgactcatccgaatacgaagtcaagaaagctttcaggcaactcgccaaaaagtaccatcctgatgtttgtagaggtagcaattgtggcgtacagtttcagacaatcaacgaagcttacgatattgtgttgaagcaaataaagaatcagatggagggaacggaagaatttgagccgttcgatgtttctgacgacggattcaacggaatgaatgatccagattgcgacacgtgggaggaatggatggggtgggaaggtgcaggaatccgtgattactcgtctcacgttaatccttatgcttgaagctttgaagatttcacaaatttcgaaatgatccaatgcacataataaataacagcagagactaaatgaacaatgtaaatatgtgaaattgtctcgtgaaagttacttaaaatgtaaatctcaacattcacgctttaagcttttaggctttcgtgaatatgg

SEQ ID NO: 4534 - DNA, 993 bp, Brassica napus
ctttaaggctccgggtttcgtatgtttgtgggaaatgtggaagcgaaaaccatttccccacagggaaacaactattgcccattgatttcgccaaagctcgaaattaaccctcctttaaaagggaacaaaagtctgaagctccaccccgttggcggcccgctctaaaactaagtggatccccggggctgcaagggctttgagaaatcatttacctttttgtatcttgaaaatttgataaacatgactattgcttaaacgatcggaggaaatggattttcgggtctatccggatcttcgttttcatcatcttcttcatcttttcggttaaagaacagcagaagaaaagacccgaagatgctgaacagaacaggagtcgtctactcgtctgttcttcatcttctgtaatggatccgtacaagacccttaagatccgacccgattcatcagaatacgaggtcaagcaagctttcagacagctcgccaaaaagtatcatcctgatgtttgcagaggaagcaactgtgaagttcagtttcagacaatcaacgaagcttacaatattgtgttgaagcaaataaagaatcagatggagggaacagaggagtttcagccattcgatgtgtatgacgagggattcaacggaatgaatgatccagattgcgacacgtgggaggaatggatgggatgggaaggtgcagggaccagagactactcctcccacgtcaatccttacgcttaaagttgaggaaatgattcgaatgcatataaataacaacatagagactataaggaacgatgtaaatacatgaaactgtctcgtgaacggtacttgaagatgtaaataaaagttatctctctttcatcatgtaaatctcaacgctaagcttgacagaaattatgtcaaagtagttaaaaaaggaaaaaacaaaaacggtggtctcgaggggggggccggcactacggatggccatatagagtgtgcgaacagcttccca

SEQ ID NO: 4535 - DNA, 720 bp, Raphanus sativus
tatatcacaaatacattttactcttaaatcctaaaaaagattgtttctttctgtaaatcatagtattctgtcttgttcaaaacatgacgattgctttaacaatcggaggaaacgtgttctcgggtctatccgtatcaaaataacatcagaagaaagaatacgaagatgctaaacagaactggagtcgtttgttcttcatcttctgtgatggatccttataagacacttaagatccgaccagattcatctgaatacgaggtcaaacaagctttcagacaactcgccaaaaagtatcatcctgatgtttgtagaggaagcaactgtggtgtacagtttcaaacaatcaacgaagcttacgatattgtgttgaagcaaataaagaatcagatggatggaacgaaggaatatgagccattcgatgtgtatgacgacggattcaacggaatgaatgatccagattgtgacacgtgggaggaatggatggggtgggaaggtgcaggaacaagagactactcttctcacgtcaacccttacgcttgaagaagatgaagaaaatgattcgaatgcacataaataacatctgaaactgatgttaatgaacgatgtagataggtctcgtgaatggttacttggaacatgtaaataaaagtagtttctccaatcatgtgaatctcaaacgttaacctacaagcaataataccattacttttaaaactgcca

SEQ ID NO: 4536 - DNA, 761 bp, Brassica oleracea
atttaactcttaaatctcaaaaagattatttatttctgtaaatcacattaccttcagtttgattctgtcttgttcaaaacatgactattgctttaaccattggaggaaacgtgttctcgggtctatccggatcaaagtccagcagaagaaagaacgcgaagatgctaaacagaacaagagtcgtttgttcttcatcttctgtgatggatccttataagacccttaagatccgacccgattcatccgaatacgaggtcaagcaagctttcagacaactcgccaaaaagtatcatcctgatgtttgtagaggaaacaactgtggggtacagtttcaaacaatcaacgaagcttacaatattgtattgaagcaaataaagaatcagatggagggaacagaggagtttcagccgttcgatgtatatgacgaggggttcaacggaatgaatgatccagattgcgacacgtgggaggaatggatgggatgggaaggtgcaggaaccagagactactcttctcacgtcaatccttacgcttaaagtaatgatccgaattgcacataaataacagccgagactgaaatggaacaatgtaaatataggtgtcgtccatgggacttaaaaatgtgaataaacgagtaatttctccaatcatgagaatctcaaacgtgaatctgcaagtaataataccattagacttctaatgtttctgtctcgactttaaaaccgtcgagggtgaagttctattatatctgtaataccaaa

SEQ ID NO: 4537 - DNA, 764 bp, Brassica napus
agtggaccctgtcaggaccggtccggaatttatggtctgacccgcgtccgcccacgcgtccgcggacgcgtgggttaactcttaaatctcaaaaaaattctttatttctgtaaatcacattacattcagtttgattctgtcttgttcaaaacatgactattgctttaaccattggaggaaacgtgttctcgggtctatccggatcaaagtccagcataagaaagaacgcgaagatgctaaacagaacaagagtcgtttgttcttcatcttctataatggatccttataagacccttaagatccgacccgattcatccgaatacgaggtcaagcaagctttcagacaactcgccaaaaagtatcatcctgatgtttgtagaggaaacaactgtggggtacagtttcaaacaatcaacgaagcttacaatattgtgttgaagcaaataaagaatcagatggagggaacagaggagtttcagccgttcgatgtatatgacgaggggttcaacggaatgaatgatccagattgcgacacgtgggaggaatggatgggatgggaaggtgcaggaaccagagactactcttctcacgtcaatccttacgcttgaagtaatgatccgaattgcacataaataacagccgagactgaaatggaacaatgtaaatataggtgtcgtccatgggacttaaaaatgtgaataaacgagtaatttctccaatcatgtgaatctcaaacgtgaatctgcaagtaataatatcattag

SEQ ID NO: 4538 - DNA, 717 bp, Brassica napus
acccacgcgtccgcaaatccatttaactcttaaatctcaaaaaaattctttatttctgtaaatcacattacattcagtttgattctgtcttgttcaaaacatgactattgctttaaccattggaggaaacgtgttctcgggtctatccggatcaaagtccagcataagaaagaacgcgaagatgctaaacagaacaagagtcgtttgttcttcatcttctataatggatccttataagacccttaagatccgacccgattcatccgaatacgaggtcaagcaagctttcagacaactcgccaaaaagtatcatcctgatgtttgtagaggaaacaactgtggggtacagtttcaaacaatcaacgaagcttacaatattgtgttgaagcaaataaagaatcagatggagggaacagaggagtttcagccgttcgatgtatatgacgaggggttcaacggaatgaatgatccagattgcgacacgtgggaggaatggatgggatgggaaggtgcaggaaccagagactactcttctcacgtcaatccttacgcttgaagtaatgatccgaattgcacataaataacagccgagactgaaatggaacaatgtaaatataggtgttgtccatgggacttaaaaatgtgaataaacgagtaatttctccaatcatgtgaatctcaaacgtgaatctgcaagtaataatatcattagacttc

SEQ ID NO: 4539 - DNA, 775 bp, Brassica rapa
  misc_feature (749)..(749): n is a, c, g, or t
acttaaaatatcacaaatccatttaactcttaaatctcaaaaagattatttatttctgtaaatcacattaccttcagtttgattctgtcttgttcaaaacatgactattgctttacccattggaggaaacgtgttctcgggtctatccggatcaaagtccagcagaagaaagaaccccaagatgctaaacagaacaagagtcgtttgttcttcatcttctataatggatccttataagacccttaagatccgacccgattcatccgaatacgaggtcaagcaagctttcagacaactcgccaaaaagcatcatcctgatgtttgtagaggaaataactgtggggtacagtttcaaacaatcaacgaagcttacaatattgtgttgaagcaaataaagaatcagatggagggaacagaggagtttcagccgttcgatgtatatgacgaggggttcaacggaatgaatgatccagattgcgacacgtgggaggaatggatgggatgggaaggtgcaggaaccagagattactcttctcacgtcaatccttacgcttgaagtaatgatccgaattgcacataaataacagccgagactgaaatggaacaatgtaaatataggtgacgtccatgggacttaaaaatgtgaataaacgagtaatttctccaatcatgtgaatctcaaacgtgaacatgcaagcaataataccattagacttgtaatgtttatgtcttgactttaaaaaccgtcnagggtgaagaagttctatgatttttg

SEQ ID NO: 4540 - DNA, 1568 bp, Brassica rapa
agatcattgtcttatccagaaaaataaagatttaaagatcagaagcaataagatgatggggcctcacgaaccattcacagacactcacatacttcaaataagacctgttcttcagtttgctgagagagtgaactaacaattatggcgaagatgatgatgatgcaacagagccagccttctttatctctccttacttcttctgtctctgactttaatggcgctaagctccacttacaagtccagtacaagaggaaggttcaacagccaaaaggagcactctatgtatcagcctccagcgaaaagaagattcttataatgggtggcactcgattcatcggtatcttcttgtccaggctccttgtcaaagaaggacatcaggttacattgttcacaagaggtaaatctcctattgccaaacaactccctggcgaatctgaccaagactttgctgacttttcttccaagattcttcacttgaaaggagacagaaaggactatgactttgtgaagtcaagtctttcagctgaaggctttgatgttgtttatgatatcaacgggagggaggctgaagaagttgagcccatattagatgcacttcctaaactagaacagtacatctactgttcttcagctggtgtttacttgaaatctgatgtcttgccacactgtgaggtggatgcagttgacccaaagagcaggcacaaggggaagctggagactgagagcttactgcaatcaaaaggtgtaaactggacttccatacgccctgtctacatctacggtccgttgaactacaaccctgtggaagaatggttcttccaccgtctcaaagctggccgccctatcccagttccaaactctggaatccagatctcacagctcggtcacgttaaggacttggcaacagcctttctcgccgtgcttggtaacgagaaagccagcagagagatattcaacatctcaggagagaagtacgtcacctttgatggcttagcaagagcttgcgcaaaggctggtgggtttccagagccagagattgttcactacaacccaaaagagttcgactttgggaagaagaaagcgttccctttccgtgaccagcatttctttgcctcggtagagaaagcaaagcatgtgcttggatggaaaccagagttcgacttggtggagggtctcactgactcatacaaccttgatttcggtcgtggaactttcagaaaagaggcggatttcaccactgacgacatgattctaagcaagaaacttgttcttcaatagaaacatattgatttgtatggttgtgtgatctcacactgaagaacattctcaagtttattgtcgtctcaaatgtattttggtttcggattgtgttcgacttcttctaagaagaggcggtctggctcttgaagtttacttagtgaaggagagagagacatagaccatagagttgaatgaaagttgcatgcaactgtccaaacgaacagaaccaaatctggactaccttcagtttttggttctcggtttatataccaggcgtaattaccacatttgtcaatacaagaaaatca

SEQ ID NO: 4541 - DNA, 1678 bp, Brassica napus
aggtccacggtatctgatagcttgatatcgcaattcgcatcggcattacggccgggggaccatgaaacagcgagacggtgagatcattgtcttatccaaaagataatacagatttaatgatcagaagcaataagatgatgggcctcacgaaccattcacatacttcaaataagacctgttcttcagtttgctgagagagtgaactaacaattatggcgaagatgatgatgatgcaacagagccagccttctttatctctccttacttcttctgtctctgactttaatggcgctaagctccacttacaagtccagtacaagaggaaggttcaacagccaaaaggagcactctatgtatcagcctccagcgaaaagaagattctcataatgggtggcactcgattcatcggtatcttcttatccaggctccttgtcaaagaaggacatcaggttacgttgttcacaagaggtaaatctcctattgccaaacaactccctggcgaatctgaccaagactttgctgatttttcctccaagattcttcacttgaaaggagacagaaaggactatgactttgtgaagtcaagtctttcagctgaaggctttgatgttgtttatgatatcaacgggagggaggctgaagaagttgagcccatattagatgcacttcctaaactagaacagtacatctactgttcttcagctggtgtttacttgaaatctgatgtcttgccacactgtgaggtggatgcagttgacccaaagagcaggcacaaggggaagctggagactgagagcttactgcaatcaaaaggtgtaaactggacttccatacgccctgtctacatctacggtccgttgaactacaaccccgttgaagaatggttcttccaccgtctcaaagctggccgccctatcccagttccaaactctggaatccagatctcacagctcggtcacgttaaggacttggcaacagcctttctggccgtgcttggtaacgagaaagccagcagagagatattcaacatctcgggagagaagtacgtcacctttgatggcttagcaagagcttgcgcaaaggctggtgggtttccagagccagagattgttcactacaaccctaaagagtttgactttggaaagaagaaggctttccctttccgtgaccagcatttctttgcctcggtggagaaagcaaagcatgtgcttggatggaaaccagagttcgatttggtggagggtctcactgactcatacaaccttgatttcggtcgtggaactttcagaaaagaggcggatttcaccactgacgacatgattctaagcaagaaacttgttcttcaatagaaacatattgatttgtatggttgtgtgatctcacactgaagaacattcgcaagtttattgtcgtctcaaatgtattttggtttcggattgtgttcgacttcttctaagaagaggcggtctggctcttgaagtttacttagtgaaggagagagagacatagaccatagagttgaatgaaagttgcatgcaactgtccaaacgaacagaaccaaatctggactaccttcagtttttggttctcggtttatataccaggcgtaattacacatttgtccatacaagaaaatcagcagtaaaaaaaaaaaaaaagggcggccgctctagaggat

SEQ ID NO: 4542 - DNA, 1477 bp, Brassica napus
  misc_feature (1447)..(1447): n is a, c, g, or t
  misc_feature (1457)..(1457): n is a, c, g, or t
tcaaataagacctgttcttcagtttgctgagagagtgaactaacaattatggcgaagatgatgatgatgcaacagagccagccttctttatctctccttacttcttctgtctctgactttaatggcgctaagctccacttacaagtccagtacaagaggaaggttcaacagccaaaaggagcactctatgtatcagcctccagcgaaaagaagattctcataatgggtggcactcgattcatcggtatcttcttatccaggctccttgtcaaagaaggacatcaggttacgttgttcacaagaggtaaatctcctattgccaaacaactccctggcgaatctgaccaagactttgctgatttttcctccaagattcttcacttgaaaggagacagaaaggactatgactttgtgaagtcaagtctttcagctgaaggctttgatgttgtttatgatatcaacgggagggaggctgaagaagttgagcccatattagatgcacttcctaaactagaacagtacatctactgttcttcagctggtgtttacttgaaatctgatgtcttgccacactgtgaggtggatgcagttgacccaaagagcaggcacaaggggaagctggagactgagagcttactgcaatcaaaaggtgtaaactggacttccatacgccctgtctacatctacggtccgttgaactacaaccccgttgaagaatggttcttccaccgtctcaaagctggccgccctatcccagttccaaactctggaatccagatctcacagctcggtcacgttaaggacttggcaacagcctttctggccgtgcttggtaacgagaaagccagcagagagatattcaacatctcgggagagaagtacgtcacctttgatggcttagcaagagcttgcgcaaaggctggtgggtttccagagccagagattgttcactacaaccctaaagagtttgactttggaaagaagaaggctttccctttccgtgaccagcatttctttgcctcggtggagaaagcaaagcatgtgcttggatggaaaccagagttcgatttggtggagggtctcactgactcatacaaccttgatttcggtcgtggaactttcagaaaagaggcggatttcaccactgacgacatgattctaagcaagaaacttgttcttcaatagaaacatattgatttgtatggttgtgtgatctcacactgaagaacattcgcaagtttattgtcgtctcaaatgtattttggtttcggattgtgttcgacttcttctaagaagaggcggtctggctcttgaagtttacttagtgaaggagagagagacatagaccatagagttgaatgaaagttgcatgcaactgtccaaacgaacagaaccaaatctggactaccttcagtttttggttctcggtttaataccaggcgaattncacatttgtncatacaagaaaatcagcagt

SEQ ID NO: 4543 - DNA, 888 bp, Brassica napus
caagaaacttccaggatctggtgaaaaccatggaagaaggcgactttttcagttgcttcagcgaaattaatagtggcatgactatgaataagaagaagatgaggaagggcactaatcataagaggtttagtgaggaacagatcaagtcacttgaggttatattcgagtccgagacgaggcttgagccgaggaagaaggtgcagttagctcgagagctagggctgcaaccaagacaagtggctatatggtttcagaacaagagggctcgttggaagtctaaacagcttgagaaagagtatgatattcttagagccaattacaataacttggcttcacaatttgaaatcattaagaaagaaaagcaagcactagtctctgagttgcagagactaaatgaagagatgcgaaagacaaaagaagaaaggaatgatgagtgttgtggtgaacaaagagttgctctaagcagcagcacatggtcagataatggaaagtatgagccagaagtcagggtaaatcaagggattgttttgtgtaatgacgacattaagacagagtattttggatttgaggaagagtccaatcatgagctcattaacattgtggagcaagctgatgatagtggcttgacttcatccgataactggggaaatttcaattctgaatctttcttagaccaatctagcagcaattacccttggtgggatttttggtcataaataaaatagtgaagagaaagagtgtgtatagttttctagataaataataaattttctttttgcattgtgatattatacggtatgttatacttgattttacaaagtcggaataaaaatcaatgtagatatatggttttttatttattttaagaatttagcatttacctcgtgc

SEQ ID NO: 4544 - DNA, 963 bp, Brassica napus
  misc_feature (67)..(67): n is a, c, g, or t
agagattccaggaaaacaataaacaaaagaaacaaaagaatccaaaattttctctccttatagaaancaagaaacttccaggatctggtgaaaaccatggaagaaggcgactttttcagttgcttcagcgaaattaatagtggcatgactatgaataagaagaagatgaggaagggcactaatcataagaggtttagtgaggaacagatcaagtcacttgaggttatattcgagtccgagacgaggcttgagccgaggaagaaggtgcagttagctcgagagctagggctgcaaccaagacaagtggctatatggtttcagaacaagagggctcgttggaagtctaaacagcttgagaaagagtatgatattcttagagccaattacaataacttggcttcacaatttgaaatcattaagaaagaaaagcaagcactagtctctgagttgcagagactaaatgaagagatgcgaaagacaaaagaagaaaggaatgatgagtgttgtggtgaacaaagagttgctctaagcagcagcacatggtcagataatggaaagtatgagccagaagtcagggtaaatcaagggattgttttgtgtaatgacgacattaagacagagtattttggatttgaggaagagtccaatcatgagctcattaacattgtggagcaagctgatgatagtggcttgacttcatccgataactggggaaatttcaattctgaatctttcttagaccaatctagtagcaattacccttggtgggatttttggtcataaataaaatagtgaagagaaagagtgtgtatagttttctagataaataataaattttctttttgcattgtgatatattatacggtatgttatacttgattttacaaagtcggaataaaaatcaatgtagatatatggttttttatttattttaagaatttagcatttacctcgtgccgaaga

SEQ ID NO: 4545 - DNA, 924 bp, Raphanus sativus
  misc_feature (444)..(444): n is a, c, g, or t
  misc_feature (726)..(726): n is a, c, g, or t
ggagagattccaggataacaataaacaaaagaaacaaaagactccaaaattttctctcctatagaaagcaagaaactcccaggatctggtgaaaaccatggaagagggcgactttatcagttgcttcagcgaaatcaatagtggcatgactatgaacaagaagaagatgaggaagggcactaatcataagaggttcagtgaggaacagatcaagtcacttgaggttatattcgagtccgagacgaggctcgagccgaggaggaaggtgcagttagctcgagagctagggctgcaaccaagacaagtggctatatggtttcagaacaagagggctcgttggaagtctaagcagcttgagaaagagtataatattcttagcgccaattacaataacttggcttcacaatttgaaatcatgaagaaagaaaagcaagcactagtctntgagttgcagagactaaatgaagagatgaaaaaaacaagagaagaaaggaatgatgaatgttgtgctgaacaaagagtggctctaggcagcagcacatggtcagataatggaaactatgagccagaagtcaggctaaatcaagggattgttctgtgtaatgacgacattaagagtgagtattttgggtttgaggaagagtccaatcatgagctcatgaacattgtggatcaagctgatgatagtggcttgacttcatccgataactggggagatttcaattntgaatctcttttagaccagtctagtagcactacccttggtgggatttttggtcataaatgaaatagtgaaaagagagagtgtgtatagttttctagattgtgttaagacaaataataaattttctttttgcattgtgatattatacggtatgttattcttgattttacaaagttggaataaaactcagtttgcattga

SEQ ID NO: 4546 - DNA, 931 bp, Brassica napus
ccacgcgtccgaaaaagataaataaaaaaatccaaaaatcttctctccttatcgaacttcaagaaacttccaggatctggtgaatacccatggaagaaggagacgctttcaattgctgcttcagcgaaattaatagtggcatgtccatgaataagaataagaagaagatgaagaagagcaataatcagaagaggtttagtgaggaacagatcaagtcacttgaggttatattcgagtccgagacgaggcttgagccgagaaagaaggtgcaggtagctcgagaactagggctgcaaccaagacaagtggctatatggtttcagaacaagagagctcgttggaagactaagcagcttgagaaagagtataacattcttagagccaactacaataatttggcatcacaatttgacatcatgaagaaagaaaagcaagctctggtctcccagttgcagagactaaatgaagagatgcataagtcaaaagaagaaagacgtgatgagtattgtggtgaacaaagagtggctcttagcagtaccacaaggtcagaaaatggaaagtgtgagccagaagttaggataaatcaagggattgttctgtgtaatgatgacattaagacagagtattttggatttgaggagtctaatcatgtgctcatgaacattgtggagcaagctgatgatagttgcttgacttcatctgataactggggaggcttcaactctgattctatcttagaccaatctagcaattacccttggtgggacttttggtcatgaacaactaagtaaagagaacgagtgtgtatatacttctgtagaatgtgttaatagagcgtgttaagataaataataatttttctttttgcatcgttatgtattatatttgatttacaaaattagaataaatctcaatgagaaaaaaaatgttc

SEQ ID NO: 4547 - DNA, 917 bp, Brassica napus
  misc_feature (862)..(862): n is a, c, g, or t
  misc_feature (866)..(866): n is a, c, g, or t
  misc_feature (868)..(869): n is a, c, g, or t
  misc_feature (874)..(874): n is a, c, g, or t
  misc_feature (880)..(880): n is a, c, g, or t
  misc_feature (886)..(886): n is a, c, g, or t
aaaaaagataaataaaaaaatccaaaaatcttctctccttatcgaacttcaagaaacttccaggatctggtgaatacccatggaagaaggagacgctttcaattgctgcttcagcgaaattaatagtggcatgtccatgaataagaataagaagaagatgaagaagagcaataatcagaagaggtttagtgaggaacagatcaagtcacttgaggttatattcgagtccgagacgaggcttgagccgagaaagaaggtgcaggtagctcgagaactagggctgcaaccaagacaagtggctatatggtttcagaacaagagagctcgttggaagactaagcagcttgagaaagagtataacattcttagagccaactacaataatttggcatcacaatttgacatcatgaagaaagaaaagcaagctctggtctcccagttgcagagactaaatgaagagatgcataagtcaaaagaagaaagacgtgatgagtattgtggtgaacaaagagtggctcttagcagtaccacaaggtcagaaaatggaaagtgtgagccagaagttaggataaatcaagggattgttctgtgtaatgatgacattaagacagagtattttggatttgaggagtctaatcatgtgctcatgaacattgtggagcaagctgatgatagttgcttgacttcatctgataactggggaggcttcaactctgattctatcttagaccaatctagcaattacccttggtgggacttttggtcatgaacaactaagtaaagagaacgagtgtgtatatacttctgtagaatgtgttaatagagcgtgttaagataaataataatttttcttttgcatcgnatgnannatatngatttncaaaantgaataaatctcaatgagaaaaaaaatgttc

SEQ ID NO: 4548 - DNA, 1380 bp, Brassica juncea
aggagaaaaaaaaaagaaacaaaaaaatccaaaagcttctctatttatcgaactcaagaaacttccaagatctggtgaacaactatggaagaaggagacgttttcaattgctgctttggcgaaattaatagtggtatgtgcatgaataagaagaagatgaagaagagcaataatcagaagaggtttagtgaggaacagatcaagtcacttgaggttatattcgagtctgagacaaggctcgagccgaggaagaaggtgcaggtagctcgagaactagggctgcaaccaagacaagtggctatatggtttcagaacaagagggctcgctggaagactaagcagcttgagaaagagtataacattcttagagccaattacaataacttggcatcacaatttgacaccatgaagaaagaaaagcaagctctggtctttgagttgcagagactaaatgaagagatgcgaaagtcaaaagaagaaagacgtgatgagtgttgtggtgaacaaagagtggctctcagcagtaccacagggtcagaaaatgaaaagtgtgagccagaagttaggataaatcaagggattggtctgtgtaatgatgacattaagacagagtattttggatttgaggaggagtctaatcatgagttcatgaacattgtggagcaagctgatgatagttgcttgacttcatctgatagatggggaggcttcaagtctgattctatcttagaccaatctagcagcaattacccttggtgggacttttggtcataaacaactaagtgaagagaacgagtgtgtatacttttgtagaatgtgttaatagagtgtgttaagataaataataaattttctttgggcatagttatgtatacgttatgttatatttgattttacaaaattagaataaaataatggagaataaaaagcataccttcatgaacgatactttaattgacaaagcgtacctcaatacattttttatcgaaagcataccataatacattattcatctagttaactaaataatcatactctaatttttatgccgagagtgaagccacgcgctcctcgacgaaatccttaattcgataaaccaactggccagcttccggcaactcaggaaagatataaaacgcatggaacatgtttggatactcgattagcgttactcttttcccggataactttaaccactcatagtaacttctctgccaatcttttaacgggtcgaacccggccacaaccaccatcgtatccggataatccagatccgatatgtcaaccacgcttggtttcgccgcctcgtgatcccggttcgctccctccggcagcatcgccctccagcaccagtcagcccgatccggcgaaaccagaggc

SEQ ID NO: 4549 - DNA, 928 bp, Raphanus sativus
  misc_feature (20)..(20): n is a, c, g, or t
  misc_feature (563)..(563): n is a, c, g, or t
ggccaggagaaaaaaagatnaaaaaaaaaaaaaatccaaaatcttctcaccttatcgaacttcaagagacttccaagatctggtgaataaccatggaagaaggagacgttttcaattgctgtttcagcgaaattaatagtggcatatccatgagtaagaagaagatgaagaagagcaatactcagaagaggtttagtgaggaacagatcaaatcacttgaggttatattcgagtctgagacgaggctcgagccgcgaaagaaggtgcaggttgctcgagaactagggctgcaaccaagacaagtggctatatggtttcagaacaagagggctcgttggaagactaagcagcttgagaaagaatataacattcttagagccaattacaataatctggcatcacaatttgacatcatgaagaaagaaaagcaagctctggtctccgagttgcagagactaaatgaagagatgcaaaagtcaaaagaagaaagacgtgatgagtgttgtggtgaacaaagaatagctctcagcagtaccacatggtcagaaaatggaaagtgtganccagaagttaggataaatcaagagattgttctgtgtaatgatgacattaagacagagtattttggatttgaggaggagtctaatcacgagcccacgaacattgtggagcaagctgatgatagttgcttgacttcatctgataattggggaggcttcaactctgattctatcttagaccaatctagcagcaattacccttggtgggactttggtcataattcataaacaaaacaactaagtgcagagaacgagtgtgtatatacttctgtagaatgtgttaatagtgtgttaagataaataattaatgttcattttgcatcgttatgcatacgttgtgttatatttgattttacaaaattagaata

SEQ ID NO: 4550 - DNA, 983 bp, Arabidopsis lyrata
agaaagaaagaagaaacaaataattccaaaaccttctctcttaatcgaaatcaagaaacttgcaagatctggtgaaaaccatggaagaaggagatttgttcaactgctgcttcagcgagattaatagtggcatgaccatgaataagaagaagatgaagaagaagagcaataaccagaagaggtttagcgaggaacagatcaagtcacttgagcttatatttgagtccgagacgaggctcgaaccgaggaagaaggttcaggtagctagagagctagggctgcaaccaagacaagtagctatatggtttcagaacaagagggctcgttggaaaactaagcaacttgagaaagagtataacattcttcgatccaattacaacaatttggcttcacaatttgaaatcatgaagaaagaaaagcaatctcttgtcactgagttgcagagacaaaatgaggagatgcaaaagcctaaagaagaaaagcatcatgagtgttgtggtgaccaaggagtggctctaagcagcagcacagagtcgcataatggaaagagtgagccagaagtgaggttaaaccaagggattgttctatgtgatgatggtgattacaacaacaacattaaaacagagtattttgggttcgaggaagagactgatcatgagctcatgaacattgtggagaaagctgatgatagttgcttgacatcttctgagaattggggaggtttcaattctgattctctgttagaccaatctagcagcaattaccctaattggtgggagttttggtcataaaaacatataagaaagaaacaaaacataagtgaagagaaagagtgtgaatagtttgtagattatgtgttaagaaaaataaattttagtttagtttaaatcttgtttcgatctatgtatctactatgttcaatactctttgtagctagttagtacttatgatgagactagaaaagttttgaagtcatcatggtt

SEQ ID NO: 4551 - DNA, 986 bp, Arabidopsis thaliana
agaaagaaagaaaaaaaagaaacaaataattccaaaaccttctctcttaatcaaaatcaagaaacttacaagatctggtgaaaaccatggaagaaggagattttttcaactgctgtttcagcgagattagtagtggcatgaccatgaataagaagaagatgaagaagagcaataaccaaaagaggtttagcgaggaacagatcaagtcacttgagcttatatttgagtctgagacgaggcttgagccgaggaagaaggttcaggtagctagagagctagggctgcaaccaagacaagtggctatatggtttcaaaacaagagggctcgatggaaaactaagcaacttgagaaagagtataacactcttagagccaattacaacaatttggcttcacaatttgaaatcatgaagaaagaaaagcaatctctggtctctgagctgcagagactaaacgaagagatgcaaaggcctaaagaagaaaagcatcatgagtgttgtggtgatcaaggactggctctaagcagcagcacagagtcgcataatggaaagagtgagccagaagggaggttagaccaagggagtgttctatgtaatgatggtgattacaacaacaacattaaaacagagtattttgggttcgaggaagagactgatcatgagctgatgaacattgtggagaaagctgatgatagttgcttgacatcttctgagaattggggaggtttcaattctgattctctcttagaccaatctagcagcaattaccctaactggtgggagttttggtcataaaagcatataagaaaaaaacagaacataagcgaagagaaagagtgtgaatagtttgtaaattatgtgttaagaaaaataaatttagtttagtttaaatcttgtttcgatctatgtatctactatgttcaatactctttgtagctaattagtagcttataatgagactagaaaagttttgaagtcaccaaggtt

SEQ ID NO: 4552 - DNA, 867 bp, Raphanus sativus
atcattcgtctcttacaaataatctcaagtatacattgatcgtttcgtattctcatcagcagagcaaacaaaacttttcccgataactatggcagaggaaaccaagaacgttgaggtgccaaaggtagagtcggaggaatcatcagcagcggccacagaggtcacagatcgtggactgttcgatttcttggggaagaagaaagatgaaacaaaaccagaggagaccgccatagcgtctgagtttgagcaaaaggttcacgtctcggagccggcgcctgaggttaaacacgtggaagaagaagaagagaagaagcatcatagtctcctcgagaagcttcaccgcagcgacagctcttcaagctcctcgagcgaggaagaaggcgaagatggtgtgaagaggaagaagaagaaggacaagaagaaggtaactagtgaaggagaggtgaagacagaggaggaggagaaaaaagggtttatggataagctgaaggagaagcttcctggacacggaaagaagcctgaagatgctccaccagcaccggttgttgctcctccggtggaggaagcgcatccggcggagaagaaagggatcttggagaagattaaggagaagcttccaggctaccatcccaagactgtagaggaggaaaagaaggataaggatgatcattaaagatatgaatcatgatgatgatgatgatgatgtgttattgtgttgaatgatgatcatcttttgcttttgtgttgttggaagtttgttggcttttttattatttcctttgttgatttcagctttccttgttatgtgttgtatattatgatttcaaaggtatttttatggtatgattattttcattttcccttaaa

SEQ ID NO: 4553 - DNA, 861 bp, Raphanus sativus
atcattcgtctcttacaaatcatcttaagtatactttgatcgtttcgtattctcatcagcagagcaaacaaaacttttttctcgataactatggcagaggaaaccaagaacgttgaggtgccaaaggtagagtcggaggaatcatcagcagcggccacagaggtcacagatcgtggactgttcgatttcttggggaagaagaaagatgaaacaaaaccagaggagaccgccatagcgtctgagtttgagcaaaaggttcacgtctcagagccggcgcctgaggttaaacacgaggaagaagaagaagagaagaagcatcatagtctcctcgagaagcttcaccgcagcgacagctcttcaagctcctcaagcgaggaagaaggcgaagatggtgtgaagaggaagaagaagaaggacaagaagaaggtaactagtgaaggaggagaggtgaagacagaggaggaggagaagaaagggtttatggataagctgaaggagaagcttcctggacacgggaagaagcctgaagatgctccacccgcaccggttgttgcacctccggtggaggaagcgcatccggcggagaagaaggggatcttggagaagattaaggagaagcttccaggctaccatcccaagactgtagaggaggaaaagaaggataaggatgatcattaaagatatgaaatcatgatgtgttctttgtgttgaatgatatgatcatcttttgcttttgtgttgttggaagtttgttggctttttattatttcctttgttgatttcagcttttccttgttatgtgttgtatatgatgatttcaaaggtgttttaatggtatgattattttcattttcccttaaa

SEQ ID NO: 4554 - DNA, 855 bp, Raphanus sativus
attcgtctcttacaaataatctcaagtatacattgatcgtttcgtattctcatcagcagagcaaacaaaacttttcccgataactatggcagaggaaaccaagaacgttgaggtgccaaaggtagagtcggaggaatcatcagcagcggccacagaggtcacagatcgtggactgttcgatttctcggggaagaagaaagatgaaacaaaaccagaggagaccgccatagcgtctgagtttgagcaaaaggttcacgtctcggagccggcgcctgaggttaaacacgtggaagaagaagaagagaagaagcatcatagtctcctcgagaagcttcaccgcagcgacagctcttcaagctcctcaagcgaggaagaaggggaagatggtgtgaagaggaagaagaagaaggacaagaagaaggtaactactgaaggagaggtgaagacggaggaggaggagaagaaaggttttatggataagctgaaggagaagcttcctggacacggaaagaagcctgaagatgctcctccacccgcaccggttgttgctcctccggtggaggaagcgcatccggcggagaagaaggggatcttggagaagattaaggagaagcttccaggctaccatcccaagactgtagaggaggaaaagaaggataaggatgatcattaaagatatgaaatcatgatgtgttctttgtgttgaatgatatgatcatcttttgtttttgtgttgttggaagtttgttggcttttttattatttcctttgttgatttcagctttccttgtcatgtgttgtatatgatgatttcaaagttgtgttttatggtatgattattttcattttccctta

SEQ ID NO: 4555 - DNA, 869 bp, Raphanus sativus
  misc_feature (51)..(51): n is a, c, g, or t
  misc_feature (818)..(818): n is a, c, g, or t
ggatatcattcgtctcttacaaatcatcttaagtatactttgatcgtttcntattctcatcagcagagcaaacaaaacttttttcgataactatggcagaggaaaccaagaacattgaggtgccaaaggtagagtcggaggaatcatcagcaggggccacagaggttacagatcgtggactgttcgatttcttggggaagaagaaagatgaaacaaaaccagaggagaccgccatagcgtctgagtttgagcaaaaggttcacgtctcggagccggcgcctgaggttaaacacgaggaagaagaagaagagaagaagcatcatagtctcctcgagaagcttcaccgcagcgacagctcttcaagctcctcaagcgaggaagaaggcgaagatggtgtgaagaggaagaagaagaaggacaagaagaaggtaactactgaaggaggagaggtgaagacagaggaggaggagaagaaagggtttatggataagctgaaggagaagcttcctggacacggaaagaagcctgaagatgctccaccggcaccggttgttgctcctccggtggaggaagcgcatccggcggagaagaaggggatcttggagaagattaaggagaagcttccaggctaccatcccaagactgtagaggaggaaaagaaggataaggatgatcattaaagatatgaatcatgatgatgatgatgatgtgttattgtgttgagtgttgatcatcttttgcttttgtgttgttggaagtttgttggctttttattatttcctttgttgatttcagctttcctttgttatgtgttgtanatgatgatttcaaaggtgttttaatggtatgattattttcattttccctta

SEQ ID NO: 4556 - DNA, 852 bp, Raphanus sativus
atcattcgtctcttacaaatcatctcaagtatacatttgatcgtttcgtattctcatcagcagagcaaagaaaacttttttcgataactatggcagaggaaaccaagaacgttgaggtgccaaaggtggcgtcggaggaatcatcagcaggggccacagaggttacagatcgtggactgttcgatttcttggggaagaagaaagatgaaacaaaaccagaggagaccgccatagcgtctgagtttgagcaaaaggttcacgtctcagagccggcgcctgaggttaagcacgagaaagaagaagaagagaagaagcatcatagtctcctcgagaagcttcaccgcagcgacagctcttcaagctcctcaagcgaggaagaaggcgaagatggtgtgaagaggaagaagaagaaggacaagaagaaggtaactaccgaaggagaggtgaagatagaggaggaggagaagaaagggtttatggataagctgaaggagaagcttcctggacacggaaagaagcctgaagatgctccagccgcaccggttgttgctcctccggtggaggaagcgcatccggcggagaagaaggggatcttggagaagatcaaggagaagcttccaggctaccatcccaagactgtggaggaggaaaagaaggataaggatgatcattaaagatatgaatcatgatgatgtgttcttttgttgaatgatgatcatcttttgcttttgtgttgttggaagtttgttggctttttattatttcctttgttgatttcagcttttccttgttatgtgttgtatatgataatttcaaaggtgttttaatggtatgattattttcattttccct

SEQ ID NO: 4557 - DNA, 858 bp, Raphanus sativus
  misc_feature (435)..(436): n is a, c, g, or t
  misc_feature (491)..(491): n is a, c, g, or t
  misc_feature (517)..(517): n is a, c, g, or t
  misc_feature (542)..(542): n is a, c, g, or t
  misc_feature (613)..(613): n is a, c, g, or t
  misc_feature (764)..(764): n is a, c, g, or t
ggatatcattcgtctcttacaaatcatcttaagtatactttgatcgtttcgtattctcatcagcagagcaaacaaaacttttttctcgataaccatggcagaggaaaccaagaacgttgaggtgccaaaggtagcgtcggaggaatcatcagcagcggccacagaggttacagatcgtggactgttcgatttcttggggaagaagaaagatgaaacaaaaccagaggagaccgccatagcgtctgagtttgagcaaaaggttcacgtctcagagccggcgcctgaggttaaacacgtggaagaagaagagaagaagcatcatagtctcctcgagaagcttcaccgcagcgacagctcttcaagctcctcaagcgaggaagaaggcgaagatggtgtgaagaggaagaagaagaaggacaagaagaaggtaactanngaaggaggagaggtgaagacagaggaggaggagaagaaagggtttatggataagntgaaggagaagcttcctggacacggnaagaagcctgaagatgctactccanccgcaccggttgtcgctcctccggtggaggaagcgcatccggcggagaagaaggggatcttggagaagatnaaggagaagcttccaggctaccatcccaagactgtagaggaggaaaagaaggataaggatgatcattaaagatatgaaatcatgatgtgttctttgtgttgaatgatgatcatcttttgcttttgtgttgttggaagtttgttggcttttnattatttcctttgttgatttcagcttttccttgttatgtgttgtatatgatgatttcaaaggtgttttaatggtatgattattttcattttccc

SEQ ID NO: 4558 - DNA, 941 bp, Brassica napus
aaagactggttgttgagtcacatttcctctctatctcagcattcacaagcaattcatttcactcgacgaacacaaaagcttctcagatttcaatatcggtttctctgagctgttgtttttcagttgtagcgatgggttctgaaggaccaacggcagtgacaatcaacatcacaggcttcaagaagttccatggagttgctgaaaacccaacggagaaaatggcaaacaacctgaaagaatatttagctaagaatcctcagtcgaaagacgttgttcttggaagctgtaccgtgcttgagacagctggtcaaggagctctcgcttctctatatcagttactacaatccgcaattaacacgaaagagtcagagtcagtgacctgtggaaaaaccatatgggttcactttggagttaatagtggcgctacgaaattcgcaattgagcaacaagctgtgaatgaagcgacgtaccgttgccctgatgaattgggttggaagcctcagcatttgcctattgttccctctgatggtccgatctcaactgtaagaaagactactcttcctgttgaagagataacaaaggccttggagaagaagggctttgaggtgataacatcagatgatgcaggtcgttttgtgtgcaactatgtctattatcactcactgagatttgcagaacagaacaagacctattcactctttgttcacgttcctcttttcgtcgctgtggatgaggagactcagatgagattcacggcttctctcctggaggtactcacttctgtttgcaagtaatgttgtcccagttgtggctgattcttgttcatgaatcatgaaccgatttgtctcgccaccaatcaataaatgaaatctaagttcacttctctactatcgcaaaagcatcttttattttcttatattacaaactacatattctaatgt

SEQ ID NO: 4559 - DNA, 1005 bp, Brassica napus
gaacaaagactggttgttgagtcacatttcctctctctctcagcattcacaagcatttcattccactcgacgaacacaaaagcttctcagatttcaatatcggtttctctgagttgtagcgatgggttctgaaggaccaacggcagtgacaatcaacatcacaggcttcaagaagtttcatggagttgctgaaaacccaacggagaaaatggcaaacaacctgaaagaatatttagctaagaatcctcagtcgaaagacgttgttcttggaagctgtaccgtgcttgagacagctggtcaaggagctctcgcttctctttatcagttactacaatccgcaattaacacgaaagaatcagagtcagtgacctgtggaaaaaccatatgggttcactttggagttaatagtggcgctacgaaattcgcaattgagcaacaagctgtgaatgaagcgacgttccgttgccctgatgaattgggttggaagcctcagcatttgcctattgttccctctgatggtccaatctcaactgtaagaaagactactcttcctgttgaagagataacaaaggccttggagaagaagggctttgaggtgataacatcagatgatgcaggtcgttttgtgtgcaactatgtctattaccactcactgagatttgcagaacagaacaagacctattcactctttgttcatgttcctcttttcgtcgctgtggatgaggagactcagatgagattcactgcttctctcctggaggtactcgcttctgtttgcaagtaatgttgtcccaattgtggctgattcttgttcatgaatcatgaaccgatttgtctcgccaccaatcaataaatgaaatataagttcacttctctactattgcagaagcatcttttattttcttatattacaaactacatattctaatgtagtgtggtattataaaacgttggagactttcttctatattctttactgacgtaaaatctagctagccttacatg

SEQ ID NO: 4560 - DNA, 1022 bp, Brassica napus
atggacgcctgctgtaccggtccggaatgtcgggtcgacccacgcgtccgcacaagcatttcattccactcgacgaacacaaaagcttctcagatttcaatatcggtttctctgagctgttgtttttcagttgtagcgatgggttctgaaggaccaacggcagtgacaatcaacatcacaggcttcaagaagtttcatggagttgctgaaaacccaacggagaaaatggcaaacaacctgaaagaatatttagctaagaatcctcagtcgaaagacgttgttcttggaagctgtaccgtgcttgagacagctggtcaaggagctctcgcttctctttatcagttactacaatccgcaattaacacgaaagaatcagagtcagtgacctgtggaaaaaccatatgggttcactttggagttaatagtggcgctacgaaattcgcaattgagcaacaagctgtgaatgaagcgacgttccgttgccctgatgaattgggttggaagcctcagcatttgcctattgttccctctgatggtccaatctcaactgtaagaaagactactcttcctgttgaagagataacaaaggccttggagaagaagggctttgaggtgataacatcagatgatgcaggtcgttttgtgtgcaactatgtctattaccactcactgagatttgcagaacagaacaagacctattcactctttgttcatgttcctcttttcgtcgctgtggatgaggagactcagatgagattcactgcttctctcctggaggtactcgcttctgtttgcaagtaatgttgtcccaattgtggctgattcttgttcatgaatcatgaaccgatttgtctcgccaccaatcaataaatgaaatataagttcacttctctactattgcagaagcatcttttattttcttatattacaaactacatattctaatgtagtgtggtattataaaacgttggagactttcttctatattctttactgacgtaaaatctagctagccttacatg

SEQ ID NO: 4561 - DNA, 1056 bp, Brassica rapa
agatttcaatatcggtttctctgagacctctgaaaattctgtccttttcatcagttattgagatctgctttgttcattccatgtcctgatatagaagtgattgatctcaaatctggttggtctttagattgttaataaagagtcactgtctgataacagcagcagctgttgtttttcagttgtagcgatgggttctgaaggaccaacggcagtgacaatcaacatcacaggcttcaagaagttccatggagttgctgaaaacccaacggagaaaatggcaaacaacctgaaagaatatttagctaagaatcctcagtcgaaagacgttgttcttggaagctgtaccgtgcttgagacagctggtcaaggagctctcgcttctctttatcagttactacaatccgcaattaacacgaaagaatcagagtcagtgacctgtggaaaaaccatatgggttcactttggagttaatagtggcgctacgaaattcgcagttgagcaacaagctgtgaatgaagcgacgttccgttgccctgatgaattgggttggaagcctcagcatttgcctattgttccctctgatggtccaatctcaactgtaagaaagactactgttcctgttgaagagataacaaaggccttggagaagaagggctttgaggtgataacatcagatgatgcaggtcgttttgtgtgcaactatgtctattaccactcactgagatttgcagaacagaacaagacctattcactctttgttcacgttcctcttttcgtcgctgtggatgaggagactcagatgagattcactgcttctctcctggaggtactcgcttctgtttgcaagtaatgttgtcccaattgtggctgattcttgttcatgaatcatgaaccgatttgtttcgccaccgatcaataaatgaaatataagttcacttctctactattgcagaagcatcttttattttcttatattacaaactacatattctaatgtagtgtggtattataaaacgtggagactttcttctatattctttactgacataaaatcta

SEQ ID NO: 4562 - DNA, 1074 bp, Raphanus sativus
  misc_feature (11)..(11): n is a, c, g, or t
gggttgtttcntcgaacttccgtccatagtggaaaatgataaaagttaggtttccattgattggataagaacaaagactggttgttggttcagtcacatttcctctctctcagcattcgcgagcaattcatttcacacgtacacaaaggcttctcagatttcaatatccgtttctctgagttgtagtaatgggttctgaaggaccaacggcagtgacaattaacatcacaggcttcaagaagttccatggagttgctgaaaaccctacggagaaaatagctagcaacctgaaagaatatttagctaagaatccccagtcgaaagacgttgttcttggaagctgtaccgtgcttgagaccgctggtcaaggagctctcgcttctctttatcagttactacagtcctcaatcaacacgaaagaatcagagtcagtgagctgtggaaaaaccatatgggttcatttgggagttaacagtggcgctacgaaattcgcaattgagcaacaagctgtgaatgaagcgacgttccgttgccctgatgaaatgggttggaaacctcagcatttgcctattgttccctctgatggtccaatctcaactgtaagaaagactactcttcctgttgaagagataacgaaggccttagagaagaagggctttgaggtgataacttcagatgatgccggtcgttttgtgtgcaactacgtctattaccactcactgagatttgcagaacagaacaagacctattcactctttgttcacgttcctcttttcgttgctgtggacgaggagactcagatgagattcacggcttctctcctggaggtactcacatctgtttgcaagtaatgttgtcctaaaatgtggctgattcttgttcatgaattgagcctatcatgaaccgatttgtcttgccaccaattatcgcctatcaataaatatgaaatataagttcacttctcttctacgttgatgcatcatcatctcacactacattagattttcaaagtatcttttattttcttatgttacaaacttgattgacttcaagccaatataaaagttgcagact

SEQ ID NO: 4563 - DNA, 1015 bp, Raphanus sativus
ggtttccattgattggataagaacaaagactggttgttgtttcagtcacatttcctctctctcagcattcacaagcaattcatttcacttctacgtacacaaaagcttctcagatttcaatatccgtttctctgagttgtagtaatgggttctgaaggaccaacggcagtgacaattaacatcacaggcttcaagaagttccatggagttgctgaaaacccaactgagaaaatagctagctacctgaaagaatatttggctaagaatccccagtcgaaagacgttgttcttggaagctgtaccgtgcttgaaacagccggtcaaggagctctcgcttctctttatcagttactacagtccgcaatcaatacgaaagaattagagtcagtgagctgtggaagaaccatatgggttcatttgggagttaacagtggcgctacaaaattcgcaattgagcagcaagctgtgaatgaagcgacgttccgttgccctgatgaaatgggttggaaacctcagcatttgcctattgttctctctgatggtccaatctcaactgtaagaaagactactctccctgttgaagagataacaaaggccttagagaagaagggctttgaggtgataacatcagatgatgcaggtcgttttgtgtgcaactacgtctattaccactcactgagatttgcagaacagaacaagacctattcactctttgttcacgttcctcttttcgttgctgtggatgaggagactcagatgagattcacggcttctctcctggaggtactcacttctgtttgcaagtaatgttcatgaattgtgcctatcatgaaccgatttgtcttgccaccagttatcgcctatcaataaatgaattataagttcacttctcttctacgtttatgcaccatcatctcacgctacattagatttgcaaagtatcttttattttcttatgttacaaacttgattgacttcaaaccaatacaaaagttgcagactttcttctatatta

SEQ ID NO: 4564 - DNA, 707 bp, Brassica napus
atcaacgcagagtacgcggggaattcacaatcttctttagaatccaaaattattgttcgaagaaaaaaaaccgaagatggcaacaacgtcaacatccacgggagatatcaagaaaaccaagtcagtagaagtgaagaagaaacttaacgtgttgatcgtcgatgatgatacagtaattcgtaaacttcacgagaatatcatcaaatcgatcggtggaatttcacagacagctaagaacggtgaggaggcagtgaacatccaccgcgacggcaatgcatctttcgaccttatcctaatggataaagaaatgcccgagagggatggactttcggcaactaagaagctaagagaaatgaaagtgacgtctatgattattggggtgacgacactggctgacaatgaagaggaacgtaaggctttcatggaagctggacttaaccattgcttggcaaaacccttaagcaaagccaagatcctccctctcatcaacaatctcatggatgcttgatggatggatgaattgtcgccactacatatctacattatacaaatatgaaaaacacatataataacgtcatacacctgtgtgtgtatgcatagatatctatccgcatgtgtgtttttagggttgttatgtttgatttttattgtgcgtggcgtgatatacaatcatgtaagtcgttacttttggcttataaaataatgaa

SEQ ID NO: 4565 - DNA, 742 bp, Brassica napus
atcaacgcagagtacgcggggaattcacaatcttctttagaatccaaaattattgttcgaagaaaaaaaaccgaagatggcaacaacgtcaacatccacgggagatatcaagaaaaccaagtcagtagaagtgaagaagaaacttaacgtgttgatcgtcgatgatgatacagtaattcgtaaacttcacgagaatatcatcaaatcgatcggtggaatttcacagacagctaagaacggtgaggaggcagtgaacatccaccgcgacggcaatgcatctttcgaccttatcctaatggataaagaaatgcccgagagggatggactttcggcaactaagaagctaagagaaatgaaagtgacgtctatgattattggggtgacgacactggctgacaatgaagaggaacgtaaggctttcatggaagctggacttaaccattgcttggcaaaacccttaagcaaagccaagatcctccctctcatcaacaatctcatggatgcttgatggatggatgaattgtcgccactacatatctacattatacaaatatgaaaaacacatataataacgtcatacacctgtgtgtgtatgcatagatatctatccgcatgtgtgtttttagggttgttatgtttgatttttattgtgcgtggcgtgatatacaatcatgtaagtcgttacttttggcttataaaataatgaataagatttgttatatgatcagatgcattcagtttc

SEQ ID NO: 4566 - DNA, 703 bp, Brassica rapa
gacaattcacaatcttctttagaatccaaaattattgttcgaagaaaaaaaaccgaagatggcaacaacgtcaacatccacgggagatatcaagaaaaccaagtcagtagaagtgaagaagaaacttaacgtgctgatcgtcgatgatgatacagtaattcgtaaactccacgagaatatcatcaaatcgatcggtggaatttcacagacagctaagaacggtgaggaggcagtgaacatccaccgcgacggcaatgcatctttcgaccttatcctaatggataaagaaatgcccgagagggatggactttcggcaactaagaagctaagagaaatgaaagtgacggctatgattattggggtgacgacactggctgacaatgaagaggaacgtaaggctttcatggaagctggacttaaccattgcttggcaaaacccttaagcaaagccaagatcctccctctcatcaacaatctcatggatgcttgatggatggatatgaattgtcgccactacatatctacattatacaaatatgaaaaacacatataatatataacgtcatacacctgtgtgtgtatgcatagatatctatccgcatgtgtgtttttagggttgttatgtttgatttttattgtgcgtggcgtgatatacagtcatgtaagtcgttacttttggcttataaaataatgaataagattt

SEQ ID NO: 4567 - DNA, 717 bp, Brassica napus
atcaacgcagagtacgcggggaattcacaatcttctttagaatccaaaatcattgttcgaagaagaaaaaaccgaagatggcaacaacatccacgggagatatcgagaaaacgaagtcagtagaagtgaagaagaaacttaacgtgttgatcgtcgatgatgatcctgtaattcgtaaacttcacgagattatcatcaaatcaatcggtggaatttcacagacagctaagaacggtgaggaggcagtgaacatccaccgcgacggcaatgcatctttcgaccttatcctaatggataaagaaatgcccgagagggatggactttcggcaactaagaagctaagagaaatgaaagtgacgtctatgattattggggtgacgacactggctgacaatgaagaggaacgtaaggctttcatggaagctggacttaaccattgcttggcaaagcccttaagcaaagccaagatcctccctctcatcaacaatctcatggatgcttgatggatggatgaattgtcgccactacatatctacattatataaatatgaaaaacacataataacgtcagcttatacacctgtgtgtgtatgcatatatctatctgcatgtgtgtgttttagggttgttatgtttgatttttatcgtgcgtggcgtgatatacaatcatgtaagtcattacttttggcttataaaataatgaataagatttcttat

SEQ ID NO: 4568 - DNA, 1118 bp, Brassica rapa
tcgctctctttctcatacgccgcaccgtaagcgaactattgaatccacgaagaaacctcgatccgtcgatactatggcaaccaacgaacccgagcacgagcacagatacgcggaggaatccggagctaacgaggatgaggacaccggagctcaggtcgctccgatcgttaggcttgaggaggttgccgtcactaccggtgaggaagacgaagacgccgtcctcgatctgaaatcgaagctgtatcggttcgataaggaagcgaatcagtggaaggagagaggtgctggtactgtgaagctcttgaagcataagagcactggcaagattaggctcgttatgaggcaatcgaaaactctcaagatctgtgctaatcatttcgttaagcagggcatgagtgttcaggaacacgttgggaatgagaagtcttgcgtgtggcacgctcgtgactttgctgatggggagctgaaggatgagcttttctgcatccgttttgcttcaattgagaactgcaaagcatttatgcagaagttcaatgaagttgctgaatccgaagtagagaaagaagagagcaaagatgcctctgacgcagctggtcttcttgagaagttgaccgtggaagagacgaaaacagaggagaaacctgtggagaaggtaaagaccgaagtggaaccagaggaaaagacaaaaaccgagccagagaaagctgatgaagaaaagaaaaccgaagaggctgttgctccctcaacttaagatgcatcaatgtttaagctcctttggcgaggtattattatagcctaaaagtgttttgatgcatccatctcgagtctgctagtgtcttggcactaactatctacacatgttttgtcgaatcatatcaagtggttgggggatcgcttgggggggttgggttttgctgagtcgttttgggttttatagttttgagtcgaaagctgagtgagtgatatgagagattaaggttggtcatcagagagagtacattggattcattgtttaaagtttcctatgggttgtttttgtatggtcttattttcatggacaagagtcggaagtcttcatttctttgaattacaaaattatatgcatgttgattttaatt

SEQ ID NO: 4569 - DNA, 1590 bp, Brassica napus
  misc_feature (1132)..(1135): n is a, c, g, or t
gaatctctctcgctctctttctcacacgccgcaccgtaagcgaactactgaatccacgaagaaacctcgatccgtcgatactatggctaccaacgaacccgagcacgagcacagagacgcggaggaatccggagctaacgaggatgaggacaccggagctcaggtcgctccgatcgttaggcttgaggaggttgccgtcaccaccggtgaggaagacgaagacgccgtcctcgatctgaaatcgaagctgtatcggtttgataaggaagcgaatcagtggaaggagagaggtgctggtactgtgaagctcttgaagcataagagcactggcaagattaggctcgttatgaggcaatcgaaaactctcaagatctgtgctaatcatttcgttaagcagggcatgagtgttcaggaacacgttgggaatgagaagtcttgcgtgtggcacgctcgtgactttgctgatggggagctgaaggatgagcttttctgcatccgttttgcttcaattgagaactgcaaagcatttatgcagaagttcaatgaagttgctgaatccgaagtagagaaagaagagagcaaagatgcctctgacgcagctggtcttcttgagaagttgaccgtggaagagacgaaaacagaggagaaacctgtggagaaggtaaagaccgaagtggaaccagaggaaaagacaaaaaccgagccagagaaagctgatgaagaaaagaaaaccgaagaggctgttgctccctcaacttaagatgcatcaatgtttaagctcctttggcgaggtattattatagcctaaaagtgttttgatgcatccatctcgagtctgctagtgtcttggcactaactatctacacatgttttgtcgaatcatatcaagtggttgggggatcgcttgggggggttgggttttgctgagtcgttttgggttttatagttttgagtcgaaagctgagtgagtgatatgagagattaaggttggtcatcagagagagtacattggattcattgtttaaagtttcctatgggttgtttttgtatggtcttattttcatggacaagagtcggaagtcttcatttctttgaattacaaaattatatgcatgttgattttaatttattnnnnaaaaaaaaaaaaaaaaaaaaaaaaaaaaaaaaaaaaaaaaaaaaaaaaaaaaaaaaaaggggggggggaaaaaaaaaaaaaaaaaaaaaaaaaaaaaaaaaaaaaaaaaaaaaaaaaaaaaaaaaaaaaaaaaaaaaaaaaaaaaaggggggggggccctttaaaggaaaaaaattttaataccgggggttggcaagccaaaatttttttaaaggggccccaaaaattaatttccgggggggggttttaaaaccccggggtgggaaaaaaccggggggttccccaaataaatccttttgaggagaacccctttttccttttggggaatgggaaaaacaaaagaaaggcccccccctgaacccttttccaaaattttggcccccctaaaggggaaaggggacccccctttaaccgcctataaaggccggggggtttgggtttacccccccactacc

SEQ ID NO: 4570 - DNA, 1124 bp, Brassica napus
gaatctctctctctctctttctcatacgccgcaccgtaagcgaactattgaatccacgaagaaacctcgatccgtcgatactatggctaccaacgaacccgagcacgagaacagagacgccgaagaatccggagccaacgaggatgaggacaccggagctcaggtcgctccgatcgttaggcttgaggaggttgccgtcactaccggtgaggaagacgaagacgccgtcctcgatctgaaatcgaagctgtatcggtttgataaggaagcgaaccagtggaaggagagaggcgctggtactgtgaagctcttgaagcataagagcactggcaagattaggctcgttatgaggcaatcgaaaactctgaagatctgtgctaatcatttcgttaaaacgggcatgagtgttcaggaacacgttgggaatgaaaagtcgtgtgtgtggcacgctcgtgactttgccgatggggagctgaaggatgagcttttctgcatccgttttgcttcaattgagaactgcaaagcatttatgcagaagttcaatgaagttgctgaatccgaagtagagaaagaagagagcaaagatgcctctgacgcagctggtcttcttgagaagttgaccgtggaagagacaaaaacagaggagaaacctgtggagaaggtgaagactgaagtggaaccagaggaaaagataacaaccgagccagagaaagctgatgaagaaaagaaaaccgaagaggctgctgctccctcaacttaagatgcatcaatgtttaagctcctttggcgaggtattattatagcctaaaagtgttttgatgcatccatctcgagtctactagtgtcttggcactaaactatctacacatgttttgtcggatcatatcaagtggttgggggatcgcttgggggggttgggttttgctgagtcgttttgggttttatagtttcgagtcgaaagcttgggtgagtgatatgagagattaaggttggttatcagaaagagagtacattggattcattgtttttaaagtttcttatgggttgtttttgtatggtcttattttcatggacaagagtcggaagtctttctttgaattacaaaattatatgcatgtttattt

SEQ ID NO: 4571 - DNA, 1168 bp, Raphanus sativus
atgttgtaaaaccccaatctctctcgctcactttctcgtacgccgcaccaactgttgaatccacgaagaaacctcacctcagtccctagattctatggcgaccaacgaacccgagcacgagaacagagacgcagaagaatccggagctaacgaggatgaggacaccggagctcaggtcgctccgatcgttaggcttgaggaagttgccgtcactaccggcgaggaagacgaagacgcaatcctcgatctgaaatcgaagctgtatcgcttcgacaaggaagcgaatcagtggaaggagagaggagctggtactgtgaagctcttgaagcataagagcactggcaagattcgtctcgttatgaggcaatccaaaactctcaagatctgtgccaatcatttcgttaaacagggcatgtctgttcaggaacacgttggaaacgagaagtcgtgtgtgtggcacgctcgtgactttgctgatggtgagctgaaggatgagcttttctgcatccgatttgcttcaattgagaactgcaaagcatttatgcagaagttcaatgaagttgctgaatctgaagtagagaaagaagagagcaaagacgcatctgacaccgctggtcttcttgagaagttgaccgttgaagagacaaaaacagaggagaaacctgtggagaaggtgaaggccgaagttgaagcagaggaaaagacaaaaagcgagccagagaaagctgatgaagaaaagaaaaccgaagaggctgttgctccctcaacttaagatgcatcaatgtttaagctcctttggcgaggtattattagccttgttttgatgcatccatctcgagtctactagtgtcttggcactaactatctacatgtgttgtcggatcatatcaagtggtttggggttgggttttgctgagtcgttttgggttttatagttttgagtctaaagtgtgggcgagtgatatgagagattacggtttggttatcttatcagtaagaatacattgaattcattgttttcagcgtttgttatgggttgtttttggatggtctttattttgaggacagggatggttgtttgttcatggacatggtcagaagtcttcatttctttgaattacaaaattatacgcattgttgattttaatttaataatccttttgttttc

SEQ ID NO: 4572 - DNA, 1172 bp, Raphanus sativus
  misc_feature (41)..(41): n is a, c, g, or t
  misc_feature (315)..(315): n is a, c, g, or t
  misc_feature (964)..(964): n is a, c, g, or t
  misc_feature (981)..(981): n is a, c, g, or t
  misc_feature (988)..(988): n is a, c, g, or t
  misc_feature (993)..(993): n is a, c, g, or t
  misc_feature (1087)..(1087): n is a, c, g, or t
  misc_feature (1120)..(1120): n is a, c, g, or t
gggtcgtacccatgttgtaaaaccccaatctctctctctcnctttctcgtacgccgcaccaactgttgaatccacgaagaaacctcatctcagtccctagattctatggcgaccaacgaacccgagcacgagaacagagacgcagaagaatccggagctaacgaggatgaggacaccggagctcaggtcgctccgatcgttaggcttgaggaagttgccgtcactaccggcgaggaagacgaagacgcaatcctcgatctgaaatcgaagctgtatcggttcgacaaggaagcgaatcagtggaaggagagaggngctggtactgtgaagctcttgaagcataagagcaccggcaagattcgtctcgttatgaggcaatctaaaactctcaagatctgtgccaatcatttcgttaaacagggcatgtctgttcaggaacacgttggaaacgagaagtcttgtgtgtggcacgctcgtgactttgctgatggagagctaaaggatgagcttttctgcatccgatttgcttcaattgagaactgcaaagcatttatgcagaagttcaatgaagttgctgaatctgaagtagagaaagaagagagcaaagatgcatctgacaccgctggtcttcttgagaagttgtccgttgaagagacaaaaacagaggagaaacctgtggagaaggtgaagaccgaagttgaagcagaggaaaagacaaaaaccgagccagagaaagctggtgaagaaaagaaaaccgaagaggctgctccctcaacttaagatgcatcaatgtttaagctcctttggcgaggtattattagccttgttttgatgcatccatctcgagtctactagtgtcttggcactaaatatctacatgtgttgtcggatcatatcaagtggtttggggttgggttttgctgagtcgttttgggttttatagttttgagtcgaaagtgtgggngagtgatatgagagatnaaggttnggttnatcagtaagaatacattgaattcattgttttcagcgtctgttattggttctttttggatggtctttattttgaggatagagatggttgttttcntggacatgagtcagaagtctttcatttctttgnattacaaaattatacgctttgttgattttattttattaatccttttgttttc

SEQ ID NO: 4573 - DNA, 1092 bp, Brassica napus
tctctctcgctctctttctcacacgccgcaccgtaagcgaactactgaatccacgaagaaacctcgatccgtcgatactatggctaccaacgaacccgagcacgagcacagagacgcggaggaatccggagctaacgaggatgaggacaccggagctcaggtcgctccgatcgttaggcttgaggaggttgccgtcaccaccggtgaggaagacgaagacgccgtcctcgatctgaaatcgaagctgtatcggtttgataaggaagcgaatcagtggaaggagagaggtgctggtactgtgaagctcttgaagcataagagcactggcaagattaggctcgttatgaggcaatcgaaaactctcaagatctgtgctaatcatttcgttaagcagggcatgagtgttcaggaacacgttgggaatgagaagtcttgcgtgtggcacgctcgtgactttgctgatggggagctgaaggatgagcttttctgcatccgttttgcttcaattgagaactgcaaagcatttatgcagaagttcaatgaagttgctgaatccgaagtagagaaagaagagagcaaagatgcctctgacgcagctggtcttcttgagaagttgaccgtggaagagacgaaaacagaggagaaggtaaagaccgaggaaaagacaaaaaccgagccagagaaagctgatgaagaaaagaaaaccgaagaggctgttgctccctcaacttaagatgcatcaatgtttaagctcctttggcgaggtattattatagcctaaaagtgttttgatgcatccatctcgagtctgctagtgtcttggcactaactatctacacatgttttgtcgaatcatatcaagtggttgggggatcgcttgggggggttgggttttgctgagtcgttttgggttttatagttttgagtcgaaagctgagtgagtgatatgagagattaaggttggtcatcagagagagtacattggattcattgtttaaagtttcctatgggttgtttttgtatggtcttattttcatggacaagagtcggaagtcttcatttctttgaattacaaaattatatgcatgttga

SEQ ID NO: 4574 - DNA, 1131 bp, Brassica oleracea
  misc_feature (296)..(296): n is a, c, g, or t
  misc_feature (302)..(302): n is a, c, g, or t
  misc_feature (315)..(317): n is a, c, g, or t
  misc_feature (380)..(380): n is a, c, g, or t
  misc_feature (396)..(398): n is a, c, g, or t
  misc_feature (416)..(416): n is a, c, g, or t
  misc_feature (428)..(428): n is a, c, g, or t
  misc_feature (434)..(434): n is a, c, g, or t
  misc_feature (455)..(455): n is a, c, g, or t
  misc_feature (535)..(535): n is a, c, g, or t
ggcgctatacaattccaaccttgtcactctctctccccagcgaacccgcgaggatatatcagcccgcagatactatggcgaccaacgaacccgagcacgagaccagagacgcggaagaggccggagctaacgaggacgaggacaccggagcccaggtcgctccaatcgttaggcttgaggaggttgccgtcactaccggcgaggaagacgaagacgccgtcctcgatctgaaatcgaagctgtatcggttcgacaaggaagcgaatcagtggaaggagagaggtgctggtactgtnaagctnttgaagcataagnnnactggcaagattcgtctcgttatgaggcaatcgaaaactctgaagatctgtgctaatcacttngttaaaccgggcatgnnngttcaggaacacgttggnaatgaaaagtcntgtgtntggcacgctcgtgactttgcngatggggagctgaaggatgagcttttctgcatccgttttgcttcaattgagaactgcaaagcatttatgcagaagttcantgaagttgctgaatctgaagtagagaaagaagagagcaaagatgcctctgacaccgctggtcttcttgagaagttgaccgtggaagagacaaaaacagaggagaaacctgtcgagaaggtgaagactgaagtggaaccagaggaaaagactaaaagcgagccagagaaagctgatgaagaaaagaaaaccgaagaggctgttgctccctcgacttaagatgcatcaatgtttaagctcctttggcgaggtattattatagcctaaaagtgttttgatgcatccatctcgagtctactagtgtcttggcactaaactatctacacatgttttgtcggatcatatcaagtggttgggggatcgcttgggggggttgggttttgctgagtcgttttgggttttatagtttcgagtcgaaagcttgggtgagtgatatgagagattaaggttggttatcagaaagagagtacattggattcattgttttaaagtttcttatgggttgtttttgtatggtcttattttcatggacaagagtccgaagtctttctttgaattacaaaattatatgcatgtttatttaattttattaatcttt

SEQ ID NO: 4575 - DNA, 1054 bp, Brassica rapa
taaaacctcccaaattctctatcgctctcacacgccgcaacgctagcaaaccaatcgaatccacgaagaaaactcgatccgtagattactatggccaccaacgaacccgagcacgagcccagagacgttgaagaagctggagctaacgaggacgaggacaccggagctcaggtcgctccgatcgttaggcttgaggaggttgccgtcactaccggcgaggaagacgaagacgccgtcctcgatctgaaatcgaagctgtatcgatttgataaggaggcgaatcagtggaaggagaggggtgctggtactgtgaagctcttgaagcataagagcactgggaagattcgtctcgttatgaggcaatcgaaaactctcaagatctgtgctaatcactttgttacacagggcatgagtgttcaggaacacgtgggaaatgaaaagtcttgtgtgtggcacgcacgtgactttgctgatggtgaactcaaggacgagcttttctgcatccgatttgcttctattgagaactgcaaagcgtttatgcagaagttcaacgaagttgctgaatctgaagtagagaaagaagagagcaaagatgcctctgacaccgctggtcttctcgagaagttgaccgttgaagagactaaaacagaggagaaacctgtggagaaggagaagactgaagtggaagcagaggagaagaaaaaaagcgagccggagaaagctgacgaagagaagaaaaccgaagaggctgttccctcaacttaagctgcatcaaagtttacgctccccagatcttggcgagacattataagcctataagtgttagatgcatctctctcgagtctaccattgtctgggcactatctatctacacatgttttgtccagtcatattgcttgtggtcgggttttgcagtgtcgtttttgggtctttagtttttgagtctgaaagtgtcggtcgaatgatatgagagattcaggggagagatttatttataagtacattggatttattgttttaaggtttttatggatcgtttttgcatggtcttatt

SEQ ID NO: 4576 - DNA, 844 bp, Brassica napus
  misc_feature (629)..(629): n is a, c, g, or t
  misc_feature (631)..(631): n is a, c, g, or t
  misc_feature (637)..(637): n is a, c, g, or t
  misc_feature (646)..(646): n is a, c, g, or t
  misc_feature (682)..(684): n is a, c, g, or t
  misc_feature (697)..(697): n is a, c, g, or t
tttgtaaaacctcccaaattctctatcgctctcacacgccgcaacgctagcaaaccaatcgaatccacgaagaaaactcgatccgtagattactatggcgaccaacgaacccgagcacgagcacagagacgttgaagaagctggagctaacgaggacgaggacaccggagctcaggtcgctccgatcgttaggctagaggaggttgccgtcactaccggcgaggaagacgaagacgccgtcctcgatctgaaatcgaagctgtatcggttcgataaggaggcgaatcagtggaaggagagaggtgctggtactgtgaagctcttgaagcataagagcactggcaagattcgtctcgtcatgaggcaatcgaaaactctcaagatctgtgctaatcacttcgttacacagggcatgagtgttcaagaacacgttggaaatgaaaagtcttgtgtatggcacgctcgtgactttgctgatggtgaactcaaggatgagcttttctgcatccgatttgcttctattgagaactgcaaagcatttatgcagaagttcaacgaagttgctgaatctgaagtagagaaagaagagagcaaagatgcctctgacaccgctggtcttctcgagaagntnaccgtngaagagacnaaaacagaggagaaacctgtggagaaggagaagacnnnagtggaagcagangagaagagaaaaagcgagccggagaaagctgacgaagagaagaaaaccgaagaggctgttccctcaacttaagctgcatcaaagtttactctccacagatcttggcgagacattataagcctataagtggtagatgcatctctctcg

SEQ ID NO: 4577 - DNA, 1079 bp, Brassica napus
tctctctctctctctttctcatacgccgcaccgtaagcgaactattgaatccacgaagaaacctcgatccgtcgatactatggctaccaacgaacccgagcacgagaacagagacgccgaagaatccggagccaacgaggatgaggacaccggagctcaggtcgctccgatcgttaggcttgaggaggttgccgtcactaccggtgaggaagacgaagacgccgtcctcgatctgaaatcgaagctgtatcggtttgataaggaagcgaaccagtggaaggagagaggcgctggtactgtgaagctcttgaagcataagagcactggcaagattaggctcgttatgaggcaatcgaaaactctgaagatctgtgctaatcatttcgttaaaacgggcatgagtgttcaggaacacgttgggaatgaaaagtcgtgtgtgtggcacgctcgtgactttgccgatggggagctgaaggatgagcttttctgcatccgttttgcttcaattgagaactgcaaagcatttatgcagaagttcaatgaagttgctgaatccgaagtagagaaagaagagagcaaagatgcctctgacgcagctggtcttcttgagaagttgaccgtggaagagacaaaaacagaggagaaggtgaagactgaggaaaagataacaaccgagccagagaaagctgatgaagaaaagaaaaccgaagaggctgctgctccctcaacttaagatgcatcaatgtttaagctcctttggcgaggtattattatagcctaaaagtgttttgatgcatccatctcgagtctactagtgtcttggcactaaactatctacacatgttttgtcggatcatatcaagtggttgggggatcgcttgggggggttgggttttgctgagtcgttttgggttttatagtttcgagtcgaaagcttgggtgagtgatatgagagattaaggttggttatcagaaagagagtacattggattcattgtttttaaagtttcttatgggttgtttttgtatggtcttattttcatggacaagagtcggaagtcttcatttctttgaattac

SEQ ID NO: 4578 - DNA, 1065 bp, Raphanus sativus
  misc_feature (60)..(62): n is a, c, g, or t
  misc_feature (185)..(185): n is a, c, g, or t
  misc_feature (197)..(197): n is a, c, g, or t
ggctcccaaattctctcacacgccgcaacgtagcgaacaatcgaatcgacgaagaaaacnnnactcgatccgttagatacactatggcgacgaccaacgagcccgagcacgagcacagagacgcggaagaagctggagctaacgaggacgaggacaccggagctcaggtcgctccgatcgttagncttgaggaagtngccgtcactaccggcgaggaagacgaagacgccgtcctcgatctgaaatcgaagctgtatcggttcgataaggaggcgaatcagtggaaggagagaggtggtggtactgtgaagctattgaagcataagagcactgggaagattcgtctcgtcatgaggcaatcgaaaactctcaagatctgtgctaatcacttcgttaaacaggggatgagtgttcaggaacacgttggaaatgaaaagtcttgtgtgtggcacgcacgtgactttgctgatggtgaactcaaggatgagcttttctgcatccgtttcgcttctattgagaactgcaaagcatttatgcagaagttcaatgaagttgctgaatctgaagtagtagagaaagaagagagcaaagatgcctctgacaccgctggtcttctcgagaagctgagcgttgaagagtcgaaaacagaggagaaacctgtggaaaaggagaagactgaagtggaagcagaggagaagaaaaaaagcgagccagagaaagctgatgaagtaaagaaaaccgaagaggctagtccctcgacttaagttgcatcaacttttaagctcccaaatcttggcgagttatttatagctatatctagtgtttgatgcatctctctcgagtctactattgcctgggcactatctatctacacatgttttgtctgagtcagatcgcttggggtcgggttttgcagtgtcgtttttgggtctatagtttttgagtctgaaagtgtcggtggaatgatatgaaagatttatttataaagtccgttggattcagtgttttttcttatggatcgttttttagatggtcttgttatgggggatagagatgatgttcgtc

SEQ ID NO: 4579 - DNA, 1150 bp, Raphanus sativus
actctctcacacgccgcaacgtagcgaacaatcgaatcgacgaagaaaactcgatccgttccgttagatactatggctaccaacgaacccgagcacgagcacagagacgcggaagaagctggagctaacgaggacgaggacaccggagctcaggtcgctccgatcgttagacttgaggaagttgccgtcactaccggcgaggaagacgaagacgccgtcctcgatctgaaatcgaagctgtatcggttcgataaggaggcgaatcagtggaaggagagaggtggtggtactgtgaagctgttgaagcataagagcactgggaagattcgtctcgtcatgaggcaatcgaaaactctcaagatctgtgctaatcacttcgttaaacaggggatgagtgttcaggaacacgttggaaatgaaaagtcttgtgtgtggcacgcacgtgactttgctgatggtgaactcaaggatgagcttttctgcatccgtttcgcttctattgagaactgcaaagcatttatgcaaaagttcaatgaagttgctgaatctgaagtagtagagaaagaagagagcaaagatgcctctgacaccgcgggtcttctcgagaagctgagcgttgaagagtcaaaaacagaggagaaacctgtggaaaaggagaagactgaagtggaagcagaggataagaagaaaagcgagccagagaaagctgatgaagtaaagaaaaccgaagaggctagtccctcagcttaagttgcatcaacttttaagctcccaaatcctgtcgaggtatttatagctatatctagtgtttggatacatctctctctcgagtctactattgtctgggcactatctatctacacatgttttgtctgagtcagattgcttggggtcgggttttgcagtgtcgtttttgggtctatagtttttgagtctgaaagtgtcggtggaatgatatgaaagatttatttataaagtacgttggattcattgtttcaagtttcttatggatcgttttttagatggtcgtgttatggggatggagatgatggtgttcgttcattaacaagagtcaggaacaacaatcatgttttctaatatatgttattcctgacaagtaaaatttcattaagaaattgacaagtaaaga

SEQ ID NO: 4580 - DNA, 760 bp, Brassica napus
gaatccacgaagaaaactcgatccgtagattactatggccaccaacgaacccgagcacgagcccagagacgttgaagaagctgtagctaacgaggacgaggacaccggagctcaggtcgctccgatcgttaggcttgaggaggttgccgtcactaccggcgaggaagacgaagacgccgtcctcgatctgaaatcgaagctgtatcggttcgataaggaggcgaatcagtggaaggagagaggtgctggtactgtgaagctcttgaagcataagagcactgggaagattcgtctcgttatgaggcaatcgaaaactctcaagatctgtgctaatcacttcgttacacagggcatgaatgttcaagaacacgttggaaatgaaaagtcttgtgtatggcacgcacgtgactttgctgatggtgaactcaaggatgagcttttctgcatccggtttgcttccattgagaactgcaaagcgtttatgcagaagttcaacgaagttgctgaatctgaagtagagaaagaagagagcaaagatgcctctgacaccgctggtcttctcgagaagttgaccgttgaagagactaaaacagaggagaaggagaagactgaggagaagagaaaaagcgagccggagaaagctgacgaagagaagaaaaccgaagaggctgttccctcaacttaagctgcatcaaagtttactctccacagatcttggcgagacattataagcctataagtggtagatgcatctctctcg

SEQ ID NO: 4581 - DNA, 931 bp, Brassica napus
gaatccacgaagaaaactcgatcattagattactatggcgaccaacgaacccgagcacgagcacagagacgttgaagaagctggagctaacgaggacgaggacaccggagctcaggtcgctccgatcgttaggctagaggaggttgccgtcactaccggcgaggaagacgaagacgccgtcctcgatctgaaatcgaagctgtatcggttcgataaggaggcgaatcagtggaaggagagaggtgctggtactgtgaagctcttgaagcataagagcactggcaagattcgtctcgtcatgaggcaatcgaaaactctcaagatctgtgctaatcacttcgttacacagggcattagtgttcaagaacacgttggaaatgaaaagtcttgtgtatggcacgctcgtgactttgctgatggtgaactcaaggatgagcttttctgcatccgatttgcttctattgagaactgcaaagcatttatgcagaagttcaacgaagttgctgaatctgaagtagagaaagaagagagcaaagaggcctctgacaccgctggtcttctcgagaagctaaccgtcgaagagacaaaaacagaggagaaggagaagacagatgaaaagaaaaaagacgagccagagaaagcgggtgaagaaaagaaaaccgaggaggctagtccctcaacttaagttgcatcaaagtttacgctccccagatcttggcgagacattatagcctataagtgttagatgcatctctctcgagtctaccattgtctgggcactatctatctacacatgttttgtccagtcatatcgcttgtggtcgggttttgcagtgtcgtttttgggtctttagtttttgagtctgaaagtgtcggtcgaatgatatgagagattcaggggagaggtttatttataagtacattggattta

SEQ ID NO: 4582 - DNA, 1022 bp, Raphanus sativus
  misc_feature (36)..(36): n is a, c, g, or t
  misc_feature (42)..(42): n is a, c, g, or t
  misc_feature (60)..(60): n is a, c, g, or t
  misc_feature (66)..(66): n is a, c, g, or t
  misc_feature (97)..(97): n is a, c, g, or t
  misc_feature (124)..(124): n is a, c, g, or t
  misc_feature (174)..(174): n is a, c, g, or t
  misc_feature (180)..(180): n is a, c, g, or t
  misc_feature (186)..(186): n is a, c, g, or t
  misc_feature (193)..(195): n is a, c, g, or t
  misc_feature (222)..(222): n is a, c, g, or t
  misc_feature (249)..(249): n is a, c, g, or t
ggagctaacgaggatgaggacaccggagctcaggtngctccnatcgttaggcttgaggangttgcngtcactaccggcgaggaagacgaagacgccntcctcgatctgaaatcgaagctgtatnggttcgacaaggaagcgaatcagtggaaggagagaggtgctggtactgtnaagctnttgaancataagnnnactggcaagattcgtctcgttatgagncaatcgaaaactctgaagatctgtgcnaatcatttcgttaaacagggcatgtctgttcaggaacacgttggaaacgagaagtcttgtgtgtggcacgctcgggactttgctgatggtgagctgaaggatgaacttttctgcatccgatttgcctcaattgagaactgcaaagcatttatgcagaagttcaatgaagttgctgaatctgaagtagagaaagaagagagcaaagatgcatctgacaccgctggtcttcttgagaagttgtccgttgaagagacaaaaacagaggagaaatctgtggagaagctgaagaccgaagttgaagcagaggaaaagacaaaaaccgagccagagaaggctgatgaagaaaagaaaaccgaagaggctgctccctcaacttaagatgcatcaatgtttaatctcctttggcgaggtattattagccttgttttgatgcatccatctcgagtctactagtgtcttggcactaactatcatctacatgtgttgtcggatcatatcaagtggtttggggttgggttttgctgagtcgttttgggtttttatagttttgagtcgaaagtgtgggtgagtgatatgagagattaaggtttggttatcagtaagaatacattgaattcattgttttcagcgtttgttatgggttgtttttggatggtctttattttgaggatagagatggttgtttgttcatggacatgagtcagaagtcttcatttcttttggattacaaaattatacgcattgttgattttaatttattaatccttttgttt

SEQ ID NO: 4583 - DNA, 598 bp, Brassica napus
agatactatggcgaccaacgaacccgagcacgagaccagagacgcggaagaggccggagccaacgaggacgaggacacaggagctcagatcgctccaatcgttaggcttgaggaggttgccatcactaccggtgaggaagacgaagacgccgtcctcgatctgaaatcgaagctgtatcggttcgacaaggaagcgaatcagtggaaggagagaggagctggtactgttaagcttttgaagcataaggatactggcaagattcgtctcgttatgaggcaatcgaaaactctgaggatctgtgctaatcactttgttaaaccgggcatggcggttcaggaacacgttggaaatgaaaagtcttgtgtatggcacgctcgtgactttgctgatggggaactcaaggatgagcttttctgcatcagatttgcttctattgagaactgcaaattatttatgcaaaagttcaatgaagttgctgaatctgaagtagagaaagaggagagcaaagatgcctctgaaacagctggtcttcttgagaagttgactgtggaagagacaaaaacagaggagaaggtgaagactgaggaaaagaaaaaa

SEQ ID NO: 4584 - DNA, 1091 bp, Brassica napus
gtttcagagaagatcatcatcttcaaagagatttatcatctcaaaatcgttcgcgttgagacggtgaatttaaattaaataacaaaaaatgggttactggaattcgaaggtcgttccaaggttcaagaagatattcgagaagaatagtgcaaagaaggctgctgctgctgaagcttgcaagacctttgatgagtctaaggaaacaatcaacaaggaaattgaggagaaaaagacagaactccaaccaaaggtcgtggagacctatgaggccacgtctgctgaagtcaaggctttggtgagagaccctaaggaggctggtttgaagaaaaactcagcggctgtgctgaagtatctcgaggctcttgtcggcatagaattccccggatcaacggctgtgaaagaagctgcctctagcttcggagctggctatgtctccggaccagtcacgttcatattcgagaaggtatgtgtgttccttccagaggaggttaagacacgggaagtacctgtggaggaggccaaaactgaagaaccagtcaaaaccgaggacccagccaaaactgaagaaccggtcaaaaccgaagaaacaagtggcgagaaggagaaggagattgttgaagagactaagaaagaagagatcgttgcaacctcggtcgttgaggagaagaaacctgaagtagaaaaggaggaggagaagaagcctgtggtcgaagaagtgaaaaaggaagaagctgcttcagctccagcggtggttgaaactccggttacggcaccagaaacaacgacaccagcgccagtggctgagccaccaaagccttgattcgtttcaagatggtatgattgctttctcttgtatgaaaacatctttgttcgtaacaaaaagaaaaaaaaaagaaactgaaaggaaccaaaaaacttattttcattctttttattttatatggtttgtctttgtgtggataaatctctgttttggaagtcgttaatgcgtttttattttatttgtattcatgtgaatttgtaacaaaatattggtggatgttttttgtgtataattatttgtatgtttcgaccaaaaaaaaaaaaaaaaa

SEQ ID NO: 4585 - DNA, 1056 bp, Brassica rapa
agagagacaattaatcagttttgtgtgtttcagagaagatcatcatcttcaaagagatttatcatctcaaaatcgttcgcgttgagacggtgaatttaaattaaataacaaaaaatgggttactggaattcgaaggtcgttccaaggttcaagaagatattcgagaagaatagtgcaaagaaggctgctgctgctgaagcttgcaagacctttgatgagtctaaggaaacaatcaacaaggaaattgaggagaaaaagacagaactccaaccaaaggtcgtggagacctatgaggccacgtctgctgaagtcaaggctttggtgagagaccctaaggaggctggtttgaagaaaaactcagcggctgtgctgaagtatctcgaggctcttgtcggcatagaattccccggatcaacggctgtgaaagaagctgcctctagcttcggagctggctatgtctccggaccagtcacgttcatattcgagaaggtatgtgtgttccttccagaggaggttaagacacgggaagtacctgtggaggaggccaaaactgaagaaccagtcaaaaccgaggacccagccaaaactgaagaaccggtcaaaaccgaagaaacaagtggcgagaaggagaaggagattgttgaagagactaagaaagaagagatcgttgcaacctcggtcgttgaggagaagaaacctgaagtagaaaaggaggaggagaagaagcctgtggtcgaagaagtgaaaaaggaagaagcttcttcagctccagcggtggttgaaactccggttacggcaccagaaacaacgacaccagcgccagtggctgagccaccaaagccttgattcgtttcaagatggtatgattgctttctcttgtatgaaaacatctttgttcgtaacaaaaagaaaaaaaaaagaaactgaaaggaaccaaaaaacttattttcattctttttattttatatggtttgtctttgtgtggataaatctctgttttggaagtcgttaatgcgtttttattttatttgtattcatgtgaatttgtaacaaaat

SEQ ID NO: 4586 - DNA, 1064 bp, Raphanus sativus
  misc_feature (868)..(868): n is a, c, g, or t
gagacaattaatcagttttctgtgtttcagagaagaataagaagatcttcaaagagatttatcatctcgaacgcgcgttgagacggtgaatttaaattaaattacaaaatgggttactggaattcgaaggttgttcccaggttcaagaagatattcgagaagaatagtgctaagaaggctgctgctgctgaagcttgcaagacctttgatgagtctaaggaaacaatcaacaaggaaattgaggagaaaaagacagaactccaaccaaaggtcgtggagacctatgaggccacgtctgctgaagtcaaggctttggtgagagaccctaaggaggctggtttgaagaaaaactctgcggctgtgctgaaatatctcgaggctcttgtcggtatagaattccccggatcaacggctgtgaaagaagctgcctctagcttcggagctggctatgtctccggaccagtcgggttcatattcgagaaggtatgtgtgttccttcccgaggaggttaagacacgggaagtacctgtggaggaagtgaaagccgaagaaccagccaagaccgaggagccagccaaaaccgaggagccagtcaaaaccgaagaaacaagtggcgagaaggagattgttgaagagaagaaagaagagaccgttgcaaccgccgtcgttgaggagaagaaacctgaagtagaaaaggaggaggagaagaagcctgtcgtagaagaagtgaaaaaggaagaagctgctccagctccagctccagcggtggttgaaactccggttacagcaccagagacgacaacgccggcgccagtggctgagccaccgaagccttgattcgtttcaagatggtacgatttgctttatnttgtatgaaaacatctttgtacgtgacaaaaaagtgaaaggaacaaaaaaaaacctgttttcattctttttattttatttggtttgtctttgtgtggataaatctctgtttttgaaagtcgttaatgtgttgtttatttgtattcatttgaatttgtaaaaaaagtattggtggatgtttttctttctttctatac

SEQ ID NO: 4587 - DNA, 1082 bp, Raphanus sativus
gaggcaattaatcagttttgtgtgttccagagaagaaagaagaagatcttcaaagagatttaacatctcaagcgcgttgagacggtgaatttaaattaaattacaaaatgggttactggaattcgaaggttgttccgaggttcaagaagatattcgagaagaatagtgctaagaaggctgctgctgctgaagcttgcaagacctttgatgagtctaaggaaacaatcaacaaggaaattgaggagaaaaagacagaactccaaccaaaggtcgtggagacctatgaggccacgtcggctgaagtcaaggctttggtgagagaccctaaggaggctggtttgaagaaaaactctgcggctgtgctgaaatatctcgaggctcttgtcggtatagaattccccggatcaacggctgtgaaagaagctgcctctagcttcggagctggctatgtctccggaccagtcgggttcatattcgagaaggtatgtgtgttccttcccgaggaggttaagacacgggaagtacctgtggaggaagtgaaaaccgaagaaccagccaagaccgaggagccagccaaaaccgaggagccagtcaaaaccgaagaaacaagtggcgagaaggagattgttgaagagaagaaagaagagaccgtcgcaaccgcggtcgttgaggagaagaaacctgaagtagaaaaggaggaggagaagaagcctgtcgtcgaagaagtgaaaaaggaagaagctgctccagctccagctccagcggtggttgaaactccggttacggcaccagctgaaacgacaacgccggcgccagtggctgagccaccgaagccttgattcgtttcaagatggtacggtttgctttatcttgtatgaaaacatctttgtacgtgacaaaaagtgaaaggaacaaaaaaaacaaactattttcattctttttattttatttggtttgtctttgtgtggataaatctctgtttctggaagtcgttgatgtgttgtttatttgtattcatttgaatttgtaaaaaaagtattggtggatgtttttctttctttctatacaaccatttgtatatg

SEQ ID NO: 4588 - DNA, 1172 bp, Thellungiella halophila
gagaattcagagagacaaattaatcagtttcttgtgtttcagaagaagaagaagaacagatcgagacgaagaagatctccaaagagatttatcatctcaaaaatcgttcgagttgagaaggttaattaaaattaaataacaaaaagatgggttactggaattcgaaggttgttccaaagttcaagaagatattcgagaaaaatagtaccaagaaagctgctgctgctgaagcttgcaagacctttgatgagtctaaggaagcaatcaacaaggagattgaggagaaaaagacagaactccaaccaaaggtcgtggaaacctatgaggccacgtctgctgaagtcaaggctttggtgagagaccctaaggaggctggtttgaagaaaaactcagcggctgtgcagaagtatctcgaggcgcttgtcaatattgaattccccggatcaacggctgtgaaagacgcttcatctagctttggagctggctatgtcgcaggaccaataacattcatattcgagaaggtatgtgtgttccttcctgaggaggtaaagacacgagaagtaccggtggagacagccaaaaccgaagaaccagccaaaacggaagagccagccaaaaccgaagaaccagccaaaaccgaagaaacaagtggtgagaaagagaaggagattgttgaaaagcccaagaaagaagagaccgttacaaccgcggtcgtggaggaaaagaaaccggaggtagagaaggaggaggagaagaagcctgtggaagaagtgaaaaaggaagaagaagctgctccggctccggctccggcggttgttgaaactccggtgaaggaaccggaaacaacgacgccggctccggtggcagaggcaccaaagccttgatttgttccaagatggtatgattgcttctcttgttgtatgaaaacatctctgtacgtaacaaaaatgaaaggaagaaactgaaaggaacataaaaaaaccttatttttcattctttttattttatttggtttgtctttgtgtggaaaaatctctgtttttttttaagtcttttatatgtttttttaaattttattcatgtgaatttgtaacaaatgtttgtggatgttttttttgtctatacattatttgtatgtttcaactttcaaccaaactcataggattcaaatc

SEQ ID NO: 4589 - DNA, 1100 bp, Brassica rapa
aattaatcagtttcgtgtatttcgaagaacagatcgagacgaagatctccaaagagatttacacctcgaaatcgttcgagttgagaaggtttatttcaggtaaaataaccaagaatgggttactggaattccaaggttgttccaaggttcaagaagatattcgagaagagtagtgttaagaaagctgccgctgctgaagcttgcaagacctttgatgagtctaaggaagcaatcaacaaggaaattgaggagaaaaagacagaactccaaccgaaggtcgtggaaacctatgaggctacgtctgccgaagtcaaggctttggtgagagaccctaaggaggctggtgtgaagaaaaactcagcagccgtgcagaagtatctcgaggcgcttgccgctatcgaatttcccggatcaacggctgcgaaagacgctgcgtctagcttcggagctggctatgtctccggaccagtcatgttcatattcgagaaagtatgtgtgttccttcccgaggaggttaagacacgggaaatacctgtggaggaagtgaaagccgaagaaccggccaaaaccgaggagccagccaaaaccgaagaatcggctaaaaccgaagaatcaagtggtgagaaagaggagattgttgaagagaccgttacaaccgccgtcgttgaggagcacaaaccagaggttgccaaggaggaggagaaaaaacctgaagaagtgaaaaaagaagaagctgcaccacccccggctccagagttggttgaaagtccggttaaggcaccagagacgaagacgccggcgccagtggctgagccatcaaagccttgatttgattcaagacggtatggttgcttctcttctatgaaaacatctgaacgtaaatgatgaaaggaacaaaaaatcttttttttcattctttttattttatctttgtgtgggtaaatctctctgttctttttttttttggaagtctttaatgtggttttatttacattcatgtgaatacaaaatgtttgttaatgttttttcctatacagttattcaaccaattagtttatcagatacacatatatatatagttctgatttattatcaaaaaa

SEQ ID NO: 4590 - DNA, 3186 bp, Saccharum officinarum
gaagaccacagtctcgcacactcgcacacccagtgtgtgctgtggtcttcctctttgaccaccttcttggagcggggagtttggggccatggggaggtggtggccggctgccctgctgggctgcgcagtggcggtggccgttctggcgggcgccgtggaatgcgcggtgacgtacgacaagaaggcggtgctgattgatgggcagaggcggattctcttctccggatccatacactaccccaggagcacccctgatatgtgggaagggctgattcagaaggctaaagatggaggcttggatgtgattcagacctatgtcttttggaatggacatgagcctacgcctggaaattactatttcgaagagaggtacgatttggtcaggttcataaagacggtccagaaggccgggctgtttgtacatctccgcatcggtccctacatttgtggcgagtggaacttcggtggcttcccagtttggttgaagtatgtaccaggcatcagcttcaggacagacaacgaacctttcaagacggcaatgcagggtttcactgagaaaattgtgggaatgatgaagagcgaaaacctctttgcatcccaaggtggcccaattatcctctctcagattgagaatgagtatgggccagaaggcaaggagtttggtgctgcaggtcaggcatatatcaactgggcagcaaagatggccatcggattgggcactggtgtgccgtgggtgatgtgcaaggaggaggatgcacctgatccagtgatcaatgcgtgcaatggtttctactgtgatgcattttctcctaacaagccttacaagcccacaatgtggactgaagcttggagtggctggttcacagaatttggtgggaccatccgccaacgaccggttgaagatctcgcatttgctgtcgctcgatttgtacagaagggtggctcttttatcaattactacatgtatcatggaggaacaaattttggccgcactgctgggggtcccttcatcacaacaagctatgattatgatgctccaattgatgaatacggacttgttagagaaccaaagcacagtcatcttaaagaactccacagagctgttaagttatgtgagcaggctttggtttctgttgacccagcaattactacccttggaaccatgcaagaggcccacgtcttccgatctccatctggttgtgcagctttccttgcaaactacaattctaactcctatgcaaaagttgtgttcaacaatgagcaatacagcctgccaccttggtcaattagcatccttcctgattgcaagaatgtagtttttaacagtgccacagttggtgttcagacatctcagatgcaaatgtggggagatggtgcctcatcaatgatgtgggagaggtatgatgaggaggttgattctctggcagctgctcctttgctcaccacaactggtttgcttgagcagcttaacgtcacaagagacagcagtgattatctgtggtacataaccagtgttgacataagcccatctgaaagctttctacaaggtggtggcaagcctctgtctctcagtgtgctgtctgctggtcacgccttgcatgtctttgtcaacggacaacttcaaggttctgcttatggtaccagggaagatcgaagaattaagtataatggcaatgctaaccttcgagctggtactaacaaaattgcactgctgagtgttgcttgtggattgccgaatgttggagtgcattatgagacatggaacactggtgttggtggtcctgttgtgcttcatgggttgaatgaaggatcacgagaccttacttggcagacttggtcctatcaggttggcctgaaaggtgaacagatgaatctgaactccctagaaggctcaacctcagttgaatggatgcaagggtcgttgatagctcaaaaccaacagccattgtcctggtatagggcttactttgagactcccagcggggatgagccattggctctggatatgggtagcatgggcaagggtcaaatctggataaatggacaaagcattggacgctactggacagcatatgcagatggcgactgcaaagagtgcagttacaccgggaccttccgggcacccaagtgtcaaacaggctgtggtcagcccacgcaacgttggtatcatgtgccaaggtcctggctgcaacccaccagaaacctattggtagtattcgaggaactcggtggggattcatcaaagattgccctagtgaagaggtcagtctcaagtgtctgtgctgatgtatctgaggatcatccaaacatcaagaactggcagattgaaagctatggcgagcgtgagtaccacagggcaaaagtgcatttgagatgcgcacctgggcagtctatttctgcgatcaaatttgcaagctttgggacacctatgggaacctgtggaaatttcgagcaaggagattgccactcagctaactctcacactgttctagagaagaaatgcattgggctccaaagatgtgtcgtcgccatctcccccgagagctttggaggagatccctgcccgagcgtgacaaaaagggtggcggtcgaggcagtatgttctcccaccgtttagccctacttctccaagtaacgaatttgaaggcgtcgacaaaaaaggattggccgaaaaccaatgtgaggagagtggaactgtaagtatcgatttcgagtagatgtggctggctggagagattaggtcttgagcttagcattgttcgtcgtcagattccagattaggattgttactctgctacatctccatgaattgttcaaagcggccagctggataattgtagctggtccaggaatggagtgtagagagaagaggagtgaaggcagaaagactgattatgcattcttttgctttgtgtcagtagctgtgtatccgtgccatctcgtctttcttgaaacggagaaagatgcaggtgaagtgttgcattgaacctttttgttctactgctagtggtaagggggaggagccttgcaattgtggcaagggaaaaaaagaacaggctttggaattgtctgtaactgaagttcagatttagtagtgcattgtttttttaaggctaaagaaacgcgtgggcgaaaaaaaaaaccttcggacgcgtgggtcgacccggttactccgcggcagtgcag

SEQ ID NO: 4591 - DNA, 3275 bp, Saccharum officinarum
  misc_feature (1073)..(1073): n is a, c, g, or t
  misc_feature (1793)..(1793): n is a, c, g, or t
  misc_feature (3273)..(3274): n is a, c, g, or t
cggacgcgtgggcagctactccctcccactgtcgctcctcccaaggacccgcccaaagaatccgtagaatccaagaaaaacaggggggaggaggagccgaggaggtggtgctggaggggaagaccagtgtgtgaagaccagtctcgcacactcgcacacccagtgtgtgctgtggtcttcctctttgaccaccttcttggagcggggagtttggggccatggggaggtggtggccggctgccctgctgggctgcgcagtggcggtggccgttctggcgggcgccgtggaatgcgcggtgacgtacgacaagaaggcggtgctgattgatgggcagaggcggattctcttctccggatccatacactaccccaggagcacccctgatatgtgggaagggctgattcagaaggctaaagatggaggcttggatgtgattcagacctatgtcttttggaatggacatgagcctacgcctggaaattactatttcgaagagaggtacgatttggtcaggttcataaagacggtccagaaggccgggctgtttgtacatctccgcatcggtccctacatttgtggcgagtggaacttcggtggcttcccagtttggttgaagtatgtaccaggcatcagcttcaggacagacaacgaacctttcaagacggcaatgcagggtttcactgagaaaattgtgggaatgatgaagagcgaaaacctctttgcatcccaaggtggcccaattatcctctctcagattgagaatgagtatgggccagaaggcaaggagtttggtgctgcaggtcaggcatatatcaactgggcagcaaagatggccatcggattgggcactggtgtgccgtgggtgatgtgcaaggaggaggatgcacctgatccagtgatcaatgcgtgcaatggtttctactgtgatgcattttctcctaacaagccttacaagcccacaatgtggactgaagcttggagtggctggttcacagaatttggtgggaccatccgccaacgaccggttgaagatctcgcatttgctgtcgctcgatttgtacagaagggtggntcttttatcaattactacatgtatcatggaggaacaaattttggccgcactgctgggggtcccttcatcacaacaagctatgattatgatgctccaattgatgaatacggacttgttagagaaccaaagcacagtcatcttaaagaactccacagagctgttaagttatgtgagcaggctttggtttctgttgacccagcaattactacccttggaaccatgcaagaggcccacgtcttccgatctccatctggttgtgcagctttccttgcaaactacaattctaactcctatgcaaaagttgtgttcaacaatgagcaatacagcctgccaccttggtcaattagcatccttcctgattgcaagaatgtagtttttaacagtgccacagttggtgttcagacatctcagatgcaaatgtggggagatggtgcctcatcaatgatgtgggagaggtatgatgaggaggttgattctctggcagctgctcctttgctcaccacaactggtttgcttgagcagcttaacgtcacaagagacagcagtgattatctgtggtacataaccagtgttgacataagcccatctgaaagctttctacaaggtggtggcaagcctctgtctctcagtgtgctgtctgctggtcacgccttgcatgtctttgtcaacggacaacttcaaggttctgcttatggtaccagggaagatcgaagaattaantataatggcaatgctaaccttcgagctggtactaacaaaattgcactgctgagtgttgcttgtggattgccgaatgttggagtgcattatgagacatggaacactggtgttggtggtcctgttgtgcttcatgggttgaatgaaggatcacgagaccttacttggcagacttggtcctatcaggttggcctgaaaggtgaacagatgaatctgaactccctagaaggctcaacctcagttgaatggatgcaagggtcgttgatagctcaaaaccaacagccattgtcctggtatagggcttactttgagactcccagcggggatgagccattggctctggatatgggtagcatgggcaagggtcaaatctggataaatggacaaagcattggacgctactggacagcatatgcagatggcgactgcaaagagtgcagttacaccgggaccttccgggcacccaagtgtcaaacaggctgtggtcagcccacgcaacgttggtatcatgtgccaaggtcctggctgcaacccaccagaaacctattggtagtattcgaggaactcggtggggattcatcaaagattgccctagtgaagaggtcagtctcaagtgtctgtgctgatgtatctgaggatcatccaaacatcaagaactggcagattgaaagctatggcgagcgtgagtaccacagggcaaaagtgcatttgagatgcgcacctgggcagtctatttctgcgatcaaatttgcaagctttgggacacctatgggaacctgtggaaatttcgagcaaggagattgccactcagctaactctcacactgttctagagaagaaatgcattgggctccaaagatgtgtcgtcgccatctcccccgagagctttggaggagatccctgcccgagcgtgacaaaaagggtggcggtcgaggcagtatgttctcccaccgtttagccctacttctccaagtaacgaatttgaaggcgtcgacaaaaaaggattggccgaaaaccaatgtgaggagagtggaactgtaagtatcgatttcgagtagatgtggctggctggagagattaggtcttgagcttagcattgttcgtcgtcagattccagattaggattgttactctgctacatctccatgaattgttcaaagcggccagctggataattgtagctggtccaggaatggagtgtagagagaagaggagtgaaggcagaaagactgattatgcattcttttgctttgtgtcagtagctgtgtatccgtgccatctcgtctttcttgaaacggagaaagatgcaggtgaagtgttgcattgaacctttttgttctactgctagtggtaagggggaggagccttgcaattgtggcaagggaaaaaaagaacaggctttggaattgtctgtaactgaagttcagatttagtagtgcattgttttctgaaggctaaagaaacgcgtgggcgaaaaaaaaaannt

SEQ ID NO: 4592 - DNA, 3022 bp, Zea mays
atggggaggtggtggccggccgccctgctgggctgcgcagtggcggtggtggccgttctggcggccgccgtggtggaatgcgcggtcacgtacgacaagaaggcggtgctcattgatgggcagaggcggattctcttctccggatccatacactaccccaggagcacccctgatatgtgggaaggactgattcagaaggctaaagatggaggcttggatgtgattcagacctatgtcttttggaacggacatgagcctacgcctggaaattactatttcgaagagaggtacgatttggtcaggttcgtaaagacggtccagaaggccggcctgtttgtacatctccgcatcggcccctacatctgcggcgagtggaacttcggtggcttcccagtttggttgaagtatgtaccaggcatcagcttcaggacagacaacgaacctttcaagacggcaatgcagggtttcactgagaaaattgttggaatgatgaagagcgaaaacctctttgcatcccaaggtggcccaattatcctctctcaggcaaattgagaatgagtatgggccagaaggcaaggagtttggtgccgcaggtcaggcatatatcaactgggcagcaaagatggcagtgggactggacactggtgtgccgtgggtgatgtgcaaggaggaggatgcacctgatccagtgatcaatgcgtgtaatggtttctactgtgatgcattttctcctaacaaaccttacaagcccacaatgtggactgaagcttggagtggctggttcacagaatttggtgggaccatccgccaacgaccggttgaagatctcgcatttgctgttgctcgatttgtacaaaagggtggctcttttatcaattactacatgtatcatggaggaacaaattttggacgcactgctgggggtcccttcatcacaacaagctatgattatgatgctccaattgatgaatatggacttattagagaaccaaagcacagtcatcttaaagaactccacagagctgttaagttatgtgaacaggctttggtttctgttgaccccacaattactacccttggaactatgcaagaggcccatgtcttccgatctccatctggttgtgcagctttccttgcaaactacaattctaactcccatgcaaaagttgtgttcaacaatgagcaatacagcctcccaccttggtcaattagcatccttcctgattgcaagaatgtagtttttaacagtgccacagttggtgttcagacatctcagatgcaaatgtggggagatggtgccacatcgatgatgtgggagaggtacgatgaggaggttgattctctggcagctgctccattgctcaccacaactggtttgcttgagcagcttaacgtcaccagagacagcagtgattatctgtggtacattaccagtgttgacataagcccatctgaaaactttctacaaggtggtggcaagcctccgtctctgagtgttcagtctgctggtcacgccttgcatgtctttgtcaacggacaacttcaaggttcttcgtatggtaccagggaggatcgaagaattaaatataatggcaatgttaaccttcgagctggtactaacaaaatcgcactactgagtgttgcttgcggattgccgaatgttggagtgcattatgagacgtggaacaccggcgtcggtggtcctgtcgtgcttcatggattgaatgaaggttcgcgagaccttacttggcagacctggtcctatcaggttggcctgaaaggcgagcagatgaatctgaactccgtagaaggctcaggctcagttgaatggatgcaagggtcactgatagctcagaagcaacagccgttggcctggtataaggcttacttcgagactcccagcggggacgagccattggctttggatatgggcagcatgggcaagggacaggtctggataaacggacaaagcattggacgctactggacagcgtatgcagacggggactgcaaagggtgcagctacaccgggaccttccgggcacccaagtgccaagcaggctgcggccagcccacccagcgttggtaccatgtgccaaggtcctggctgcagcccagcagaaacctactggtagtcttggaggaactgggtggtggggactcgtcgaagatcgccctagccaagaggtcggtctcgagcgtctgtgccgacgtgtccgaggaccatccgaacatcaagaagtggcagatcgagagctacggcgagcgcgagcaccgcagggccaaggtgcacctgaggtgcgcgcacgggcagtccatctccgcgatcagattcgcgagcttcgggacgcctgtgggcacctgcggcaacttccagcagggaggctgccactcggctagctctcacgctgtgctagagaagagatgcattgggctccagagatgcgtcgtcgccatctcccccgacaacttcggaggagacccctgcccgagcgtgacgaagagggtggcggtcgaggcggtgtgctctcccgccgcttaggcttagcctgcccgcccgcccctacttctccgactcaccgagcaacggatttgaaggccgaaaccgatgtgtgtggagagtggaactgtaagtatcgacttgcattggtcggagggaggtttagcattcgtccgtctgattccggattaggattggtgctctgctacgtctccatgaactgttcaaagcggccagctgggtccagggatggagctgtagagagagtaggagtagaagactgatcatgcgttcttttgctgttgtgtgttagtagtagctgtgtacctacccgtgacacatctcgtttttcttgaaacggaggaagacgcaggtgaagcgtgcatcgtgcctttgttgttgcaattgtgttgtgtgtggtgggggaggaaaaaaaaagaacaggctttgatgttctcagaagctcaagttcagatctgatagtgcatggaaaatcatgaaccctgaggaatcgattttcgc

SEQ ID NO: 4593 - DNA, 2890 bp, Pennisetum glaucum
cgtcgaatgcgcggtgacgtacgacaagaaggcggtgctcatcgacggccagaggcggattctcttctccggatccatacactaccccaggagcacccccgatatgtgggaagggctgattcagaaggctaaagatggaggcttggatgtgattcagacttatgtcttttggaatggacatgagcctactcctggaaattactatttcgaagagaggtacgatttggtcaggttcgtaaagactgtccagaaggccgggctgtttgtacatctccgcattggtccctatatttgtggcgagtggaatttcggtggcttcccagtttggttgaagtatgtaccaggaatcagcttcaggacagataacgaacctttcaagacggcaatgcagggtttcactgagaaaattgtgggaatgatgaagagcgaaaacctctttgcttcccaaggtggccctatcatcctatcacagattgaaaatgagtatggcccggaaggcaaagagtttggtgctgcaggccagtcatatatcaattgggctgcaaagatggctgttggattgggcactggtgtgccgtgggtgatgtgcaaggaggaggatgcaccagatccagtgatcaatgcatgcaatggtttctactgtgatgcattttctcctaacaagccttacaagcctatgatgtggactgaagcttggagtggctggttcacagaatttggtgggactatccgccagcgaccggttgaagacctcgcatttgccgttgctcgatttgtacaaaagggtggttcatttatcaattactacatgtatcatggaggaacaaattttggacgtactgctgggggtcccttcatcactacaagttatgattatgatgctccaattgatgaatatggacttgttagagaaccaaagcatagtcatctaaaagaactccacagagccgtcaagttatgtgagcaggctttggtttctgttgacccggcaattactacccttggaaccatgcaagaggcccatgtcttccgatctccatctggttgtgctgctttccttgcaaactacaattctaattcctatgcgaaagttgtgttcaacaatgagcattacagccttccaccttggtcaatcagcattcttcctgattgcaagaatgtagtttttaacagtgcaacggttggtgttcagacatctcaaatgcaaatgtgggcagatggggcctcctcaatgatgtgggagaggtatgatgaggaggtcgattctcttgcagctgctccattgctcacgacaacaggtttgcttgagcagcttaatgtcacgagagacagcagtgactatctgtggtatatcaccagtgttgagatcagcccatctgaaaactttctacaaggtggcaaacctctgtctctcagtgtgcaatctgctggtcacaccttgcacatctttatcaatggacagcttcaaggttctgcttatggtaccagggaagatcgaagaattaaatataatggcaatgctaaccttcgagctggtacaaataaagttgcactactgagtgttgcctgtggattgccgaatgttggagtgcattatgaaacatggaacactggtgttgttggtcctgttgtccttcatgggttggatgaaggttcacgagaccttacttggcagacttggtcctatcaggttggcctgaaaggtgaacagatgaacctgaactccctacaaggctcaagctcagttgaatggatgcaagggtcgttgttagcacaaaaccaacaaccattggcctggtatagggcttacttcgagactcccagtggggatgaaccactggctctggatatgggtagcatgggcaagggacaaatttggataaatggacaaagcattggacgttactggacagcatatgcaaatggggactgcaaaggatgcagttacacggggacattccgggcacccaagtgtcaagccggctgcggtcagcccacacagcgctggtatcatgtgccaagatcctggctgcaacccacaagaaatttgctggttgtttttgaggaacttggtggggattcatcgaagattgctcttgtgaagaggtcagtgtcaagtgtctgcgctgatgtatctgaggatcatccaaatatcaagaagtggcagattgagagctatggtgagcgcgagtaccacagggccaaagtgcacttaaaatgtgcacctgggcaatctatttctgccatcaaatttgcaagctttgggacacctatgggaacttgcgggagtttccagcaaggagattgccattcagctaactctcacactgttgtcgagaagaaatgcattggcctacaaaggtgtgtcgtcgctatctctcccgagaactttggaggggatccctgcccgaacgtgacgaaaagggttgcagtcgaggcagtatgttctcccactgcttagcctacttctccaagctaatgcatttgaaggcgatcgctggccaaaaccaatgcggagagtcgaattgtaagtatcgacttggagtagacgatgtggttggtcggattaggtcgtgaacttagcattcgtaattgtgggggtcagattccagattaggattgatgccctactgcatctccatggattgttcaaagcggccactttggtaactgaagctggtccgggaatggagtgtagaggacggggagcaaacgcaaaagattgatgatacattcttttgcttgtattagtagtagtagtccgcgagctaggtatcctgcctttcttgaaacggagaaagatgcggggtgaagagtgcactgtaccgttttttttttttttgtctattcgacaatggcaatacgaggagactgtgtgcctgaagttgcc

SEQ ID NO: 4594 - DNA, 3352 bp, Oryza sativa
aactactacggggttgagagagagagagagagagagagagagagagagagagaatggccattataatagagccataggccaaaagctcaactgcactgagagcagcatcagcagcagttcactgtcactcttcccaagaacgggtgccaaggaatcctagaatccaagaaaggcagcagctgctgcagcaagaacagcacagggggagaggtggtggtggtggtggtggggaagaagaccacacacattcggctgggtggtggtcttcttcttctgctgctgctgccgctgttgccgcttgttggagtgaggagagtgggtgagtgatggggagggggtgcctggctgcgctgctcggcggcgcggtggcggtggccgtgctggtcgccgtcgtccactgcgcggtgacgtacgacaagaaggcggtgctcgtcgacggccagaggaggattctcttctccggatccatacattacccgaggagcacacccgaaatgtgggacgggctaattgagaaggctaaagatggaggcttggatgtgatccagacctatgtcttttggaatgggcatgaaccaactcctggaaattacaattttgaagggaggtacgatctggtcaggttcatcaagactgtccagaaggctggcatgtttgttcatctccgcatcggtccctacatttgtggagagtggaattttggtggatttccagtttggttgaagtatgtaccaggcatcagcttcaggacggacaatgaacctttcaagaatgcaatgcaggggttcacagagaaaattgtgggcatgatgaagagtgaaaacctctttgcttcacaaggcggtcctattatcctctctcagattgagaacgagtatgggccagaaggtaaagagtttggggctgccggcaaggcatatatcaactgggcggcaaagatggccgtgggattggacaccggtgtgccgtgggtgatgtgcaaggaggatgacgcacctgacccagtgatcaatgcatgcaatggtttctattgtgacacattttctcctaacaagccttacaagcctacgatgtggactgaagcttggagtggatggtttactgaattcggaggaaccatccgtcaacgaccagttgaagatctcgcatttggtgttgctcgcttcgtacagaagggtggttcttttatcaactactacatgtatcatggaggaacgaattttggtcgcacggctggaggtccctttatcaccacgagctatgattatgatgctccacttgatgaatatggacttgcaagggaaccaaagtttgggcaccttaaagaactccatagagctgttaagttatgtgagcagcctttggtttctgccgatccaactgtgactacccttggaagtatgcaagaggcccatgtgttccgatcttcctctggctgtgcagctttccttgcaaactacaattctaactcgtatgccaaagttatcttcaacaatgaaaattacagccttccaccttggtcaatcagcatccttcctgattgcaaaaatgttgtttttaacactgcaacagttggtgttcagacaaatcaaatgcaaatgtgggcagacggggcttcttcaatgatgtgggagaagtatgatgaggaggttgattcattggcagctgctccattgctcacgtcaactggtctacttgagcagcttaatgtcacaagagacaccagtgattacctctggtacattacgagtgtggaggtagacccatctgagaagtttctacaaggtggcacgcctctgtcactcactgtgcagtctgctggccatgcgctgcatgtcttcatcaatgggcaactccaaggttctgcctatggaaccagggaagatcggaaaatctcatatagtggcaatgctaaccttcgtgctggtacaaacaaagttgcactgttgagtgttgcttgtggactgccgaatgtcggagtgcattatgagacgtggaacactggtgttgttggtcctgttgtgattcacgggttggacgaaggttcaagagatctgacttggcagacttggtcctatcaggttggcctgaaaggtgaacagatgaatctaaactccttagaaggctcaggctcagttgaatggatgcaaggatcattggtagcacaaaaccaacaaccgttggcatggtatagggcatactttgatactcccagtggtgacgagccactggctctggatatgggcagcatgggtaagggtcaaatatggataaatgggcaaagcattggacggtactggacagcatatgcggaaggtgactgcaaaggttgccattacactgggtcatacagggcacccaagtgtcaggcaggttgtggtcagcctacacagcgctggtatcatgtgccaagatcctggttgcaaccaactagaaatctgctagtggtttttgaggaacttggcggtgattcttcaaagattgcccttgcgaagcggacagtctcaggtgtctgtgctgatgtatctgaatatcatccaaatatcaagaactggcagatcgagagctatggggaaccagagttccacacggcaaaggtgcatttaaaatgtgcacctgggcagaccatttctgcaatcaaatttgctagctttgggacacctcttggaacttgcggaacattccagcaaggggagtgccattcaattaactcaaactctgttcttgaaaagaaatgcattggactacaaagatgtgtcgtcgcaatctctcccagcaactttggtggagatccctgcccggaggtgatgaaaagggtggcggttgaggcggtatgctctaccgctgcatagggcaatttctttgccgagacgaatttagagatggcaccaaacaggtgggcttgtgcttgatcaaagcacacagaaagcgatgcagagtagagttcaactgtaaagtatcgacgccacatagctgtggctggaggattagagatcgattctagcattcactcagtcgaatttcagattagaggattctaactctactgcatctccatgaattgttcagagtgaccaactgctaattgaagttggtcctgggatggagtgcagggagagtaaaggcaaaagattggtgcattcttttgctcgcgttagtgtgcgtgttgtgttgtttcatctttcttgaaaggaagaaagatgccgatgaattgtgcatgtatcccatatgaggaatcgttgattgtgcagtgagcatgatatgctgcagaacaattgctcgtgtcatattctgaagttcagaaaagaggttgtcaatttatcttcttcagataaaccatataattcttgtg

SEQ ID NO: 4595 - DNA, 3411 bp, Zea mays
ctcccactgtcgccctctcccaagaacccgcccaaagaatcctagaatccaagaagaagggcagcaacaaaaaacaaggggcggggggggctgcaggtctgagggcggagggggaggaggtggtgctgccgtgctggaagaccagtgtgtgaagaccacacagagtctctcgcgcacccggtgtgctgtgctgtggtcttcctctttgaccgccttctcggagcggggagtttggccatggggaggtggtggccggccgccctgctgggctgcgcagtggcggtggtggccgttctggcggccgccgtggtggaatgcgcggtcacgtacgacaagaaggcggtgctcattgatgggcagaggcggattctcttctccggatccatacactaccccaggagcacccctgatgtaataagctgcattcttcaaaacctctccttctttttttccccccttcttccccggggcggcggggagttcatggctgtggtcagctgtgttcttgatgcaatgctatcaaaagcaaattgctttcctactttagccgtccctctttattccacgatgtgggaaggactgattcagaaggctaaagatggaggcttggatgtgattcagacctatgtcttttggaacggacatgagcctacgcctggaaattactatttcgaagagaggtacgatttggtcaggttcgtaaagacggtccagaaggccggcctgtttgtacatctccgcatcggcccctacatctgcggcgagtggaacttcggtggcttcccagtttggttgaagtatgtaccaggcatcagcttcaggacagacaacgaacctttcaagacggcaatgcagggtttcactgagaaaattgttggaatgatgaagagcgaaaacctctttgcatcccaaggtggcccaattatcctctctcagattgagaatgagtatgggccagaaggcaaggagtttggtgccgcaggtcaggcatatatcaactgggcagcaaagatggcagtgggactggacactggtgtgccgtgggtgatgtgcaaggaggaggatgcacctgatccagtgatcaatgcgtgtaatggtttctactgtgatgcattttctcctaacaaaccttacaagcccacaatgtggactgaagcttggagtggctggttcacagaatttggtgggaccatccgccaacgaccggttgaagatctcgcatttgctgttgctcgatttgtacaaaagggtggctcttttatcaattactacatgtatcatggaggaacaaattttggacgcactgctgggggtcccttcatcacaacaagctatgattatgatgctccaattgatgaatatggacttattagagaaccaaagcacagtcatcttaaagaactccacagagctgttaagttatgtgaacaggctttggtttctgttgaccccacaattactacccttggaactatgcaagaggcccatgtcttccgatctccatctggttgtgcagctttccttgcaaactacaattctaactcccatgcaaaagttgtgttcaacaatgagcaatacagcctcccaccttggtcaattagcatccttcctgattgcaagaatgtagtttttaacagtgccacagttggtgttcagacatctcagatgcaaatgtggggagatggtgccacatcgatgatgtgggagaggtacgatgaggaggttgattctctggcagctgctccattgctcaccacaactggtttgcttgagcagcttaacgtcaccagagacagcagtgattatctgtggtacattaccagtgttgacataagcccatctgaaaactttctacaaggtggtggcaagcctccgtctctgagtgttcagtctgctggtcacgccttgcatgtctttgtcaacggacaacttcaaggttcttcgtatggtaccagggaggatcgaagaattaaatataatggcaatgttaaccttcgagctggtactaacaaaatcgcactactgagtgttgcttgcggattgccgaatgttggagtgcattatgagacgtggaacaccggcgtcggtggtcctgtcgtgcttcatggattgaatgaaggttcgcgagaccttacttggcagacctggtcctatcaggttggcctgaaaggcgagcagatgaatctgaactccgtagaaggctcaggctcagttgaatggatgcaagggtcactgatagctcagaagcaacagccgttggcctggtataaggcttacttcgagactcccagcggggacgagccattggctttggatatgggcagcatgggcaagggacaggtctggataaacggacaaagcattggacgctactggacagcgtatgcagacggggactgcaaagggtgcagctacaccgggaccttccgggcacccaagtgccaagcaggctgcggccagcccacccagcgttggtaccatgtgccaaggtcctggctgcagcccagcagaaacctactggtagtcttggaggaactgggtggtggggactcgtcgaagatcgccctagccaagaggtcggtctcgagcgtctgtgccgacgtgtccgaggaccatccgaacatcaagaagtggcagatcgagagctacggcgagcgcgagcaccgcagggccaaggtgcacctgaggtgcgcgcacgggcagtccatctccgcgatcagattcgcgagcttcgggacgcctgtgggcacctgcggcaacttccagcagggaggctgccactcggctagctctcacgctgtgctagagaagagatgcattgggctccagagatgcgtcgtcgccatctcccccgacaacttcggaggagacccctgcccgagcgtgacgaagagggtggcggtcgaggcggtgtgctctcccgccgcttaggcttagcctgcccgcccgcccctacttctccgactcaccgagcaacggatttgaaggccgaaaccgatgtgtgtggagagtggaactgtaagtatcgacttgcattggtcggagggaggtttagcattcgtccgtctgattccggattaggattggtgctctgctacgtctccatgaactgttcaaagcggccagctgggtccagggatggagctgtagagagagtaggagtagaagactgatcatgcgttcttttgctgttgtgtgttagtagtagctgtgtacctacccgtgacacatctcgtttttcttgaaacggaggaagacgcaggtgaagcgtgcatcgtgcctttgttgttgcaattgtgttgtgtgtggtgggggaggaaaaaaaaagaacaggctttgatgttctcagaagctcaagttcagatctgatagtgcatggaaaatcatgaaccctgaggaatcgattttcgc

SEQ ID NO: 4596 - DNA, 3002 bp, Brachypodium distachyon
gggagtgatggcgcggcggtggccggctgccctgctctgctgggcggcggcggcggccttgcttgcggccgccgtggagtgtgcggtgacctacgacaagaaggcggtgctcatcgacgggcagaggaggattctcttctccggatccatacattaccccaggagcacccccgaaatgtgggaagggctatttcagaaggccaaagatggaggcttagatgtgatccagacttacgtcttctggaatgggcacgaaccaactcccggaaattacaatttcgaagggaggtacgatttggtcaagttcattaagaccgcccagaaggccgggctgttcgtacatctccgtatcggtccctacatttgcggggagtggaatttcggtggctttccagtttggttgaagtatgttccgggcatcagcttcaggacagacaatgagcctttcaagacggcaatgcaggggttcacagagaaaatcgtaggaatgatgaagagcgaagaactctttgcttcccaaggtggccctattatcctttcgcagattgagaatgaatatggaccagaagggaaatcatttggtgctgctggcaagtcatatagtaactgggcagcaaagatggccgtgggattggacactggtgtgccgtgggtgatgtgcaagcaggatgatgcaccagatccagtgataaatgcatgcaatggtttctactgtgatgcattttctccaaacaagccttacaagcctacgatgtggactgaagcttggactggttggtttactgaatttggtgggaccatccgtaaacgaccggttgaagatctttcatttgctgttgctcgtttcgtacagaagggtggttcatttatcaactactacatgtatcacggaggaacaaattttgggcgcactgctggaggtcccttcatcacaacaagctatgattatgatgctccacttgatgaatatggacttgcgagagaaccaaagtatggacatcttaaagaactccatagagctgtcaagttatgtgagccggcgttggtttctgttgatccagctgtgactactcttggaagtatgcaagaggcccatgtcttccgatctccatccagttgtgcagcttttctcgcgaactacaattctaactctcatgcaaatgttgtcttcaacaatgagcattacagccttccaccttggtcaatcagcatcctgcctgattgcaaaactgttgtttttaacaccgcaactgttggtgttcagacatctcaaatgcaaatgtgggcagatggggagtcttcaatgatgtgggagagatatgatgaggaggttggttcactagcagctgctcctttgctcaccacaactggtctactggaacagctcaacgtcacgagagacagcagtgattatctatggtacatcaccagtgtggatgtaagcccatctgaaaaatttctacaaggtggcgaacctctgtctctcactgtgcaatctgctggacatgccttgcatatctttatcaatggacagctacaaggttctgcctctggaacaagggaagctaaaaaattctcatataagggcaatgccaaccttcgtgctggtactaacaaaattgcactgctgagtattgcttgtggactgccgaatgtcggggtgcattatgagacatggaatactggtatcgttggtcctgttgtgcttcatgggttggacgtgggctcgcgagatctcacctggcagacttggtcctatcaggttgggctgaaaggtgaacagatgaatctgaattccttagaaggcgcaagctcagttgagtggatgcaaggatcattgttagcacaagcgccattgtcatggtatagggcatactttgatactccgactggtgacgaacctctggctctggatatgggtagcatgggaaagggccaaatctggataaatggacaaagcattggacggtactcgacatcatatgcaagtggggactgcaaagcttgcagttacgccggatcataccgggcacccaaatgtcaagcaggttgcggtcagcccacacaacgttggtatcatgtgccaaaatcctggttgcaaccatcaagaaatctattagttgtttttgaggaacttggtggggattcttcgaagatttcccttgtgaaaaggtcagtctcaagtgtatgcgctgatgtatccgagtatcatacgaacatcaagaactggcagattgagaatgcaggggaggttgagttccacaggccgaaggtgcatttaagatgtgcacctggtcagactatttctgccataaaatttgctagctttgggacacctcttgggacctgtggaaatttccagcaaggggattgccattcaactaagtcacacgctgttcttgagaagaactgcattgggcaacaaagatgcgccgtcaccatctcccccgataactttggtggagatccctgccctaaggagatgaaaaaggtggcagttgaggcggtgtgttctcctggtacataggtgacttcttcgactagactaatttaaaagcagtgtcgaaaacggtggccttgtgcatgatcaagctgagctagcagagaggagagttcaattgtaaagtgtcgacttcacctagatgcggctggaggattagaaggccattggtagcattccttcatgtcggattcagattagttccgtgctctactgcatctccatgaattgttcaaagcgaccaactggtaattgaggttggtcctggaatgggatgcaaggagagtagaggcaaaagactcgatgcattcttttgcattgtgctagtatgtgtggcctgtctcgcctgtttttcttgaagaagaaagatgcagggtgatttgtgcatgtatccttattttgagatacttgctatcagaggaacctctaatttctgaaggttgctcacttgctctttcttaaggtggtaaaccacctggaactcgaaggagatttatgccaa

SEQ ID NO: 4597 - DNA, 2530 bp, Brachypodium distachyon
gggagtgatggcgcggcggtggccggctgccctgctctgctgggcggcggcggcggccttgcttgcggccgccgtggagtgtgcggtgacctacgacaagaaggcggtgctcatcgacgggcagaggaggattctcttctccggatccatacattaccccaggagcacccccgaaatgtgggaagggctatttcagaaggccaaagatggaggcttagatgtgatccagacttacgtcttctggaatgggcacgaaccaactcccggaaattacaatttcgaagggaggtacgatttggtcaagttcattaagaccgcccagaaggccgggctgttcgtacatctccgtatcggtccctacatttgcggggagtggaatttcggtggctttccagtttggttgaagtatgttccgggcatcagcttcaggacagacaatgagcctttcaagacggcaatgcaggggttcacagagaaaatcgtaggaatgatgaagagcgaagaactctttgcttcccaaggtggccctattatcctttcgcaggcaagtattgagaatgaatatggaccagaagggaaatcatttggtgctgctggcaagtcatatagtaactgggcagcaaagatggccgtgggattggacactggtgtgccgtgggtgatgtgcaagcaggatgatgcaccagatccagtgataaatgcatgcaatggtttctactgtgatgcattttctccaaacaagccttacaagcctacgatgtggactgaagcttggactggttggtttactgaatttggtgggaccatccgtaaacgaccggttgaagatctttcatttgctgttgctcgtttcgtacagaagggtggttcatttatcaactactacatgtatcacggaggaacaaattttgggcgcactgctggaggtcccttcatcacaacaagctatgattatgatgctccacttgatgaatatggacttgcgagagaaccaaagtatggacatcttaaagaactccatagagctgtcaagttatgtgagccggcgttggtttctgttgatccagctgtgactactcttggaagtatgcaagaggcccatgtcttccgatctccatccagttgtgcagcttttctcgcgaactacaattctaactctcatgcaaatgttgtcttcaacaatgagcattacagccttccaccttggtcaatcagcatcctgcctgattgcaaaactgttgtttttaacaccgcaactgttggtgttcagacatctcaaatgcaaatgtgggcagatggggagtcttcaatgatgtgggagagatatgatgaggaggttggttcactagcagctgctcctttgctcaccacaactggtctactggaacagctcaacgtcacgagagacagcagtgattatctatggtacatcaccagtgtggatgtaagcccatctgaaaaatttctacaaggtggcgaacctctgtctctcactgtgcaatctgctggacatgccttgcatatctttatcaatggacagctacaaggttctgcctctggaacaagggaagctaaaaaattctcatataagggcaatgccaaccttcgtgctggtactaacaaaattgcactgctgagtattgcttgtggactgccgaatgtcggggtgcattatgagacatggaatactggtatcgttggtcctgttgtgcttcatgggttggacgtgggctcgcgagatctcacctggcagacttggtcctatcaggttgggctgaaaggtgaacagatgaatctgaattccttagaaggcgcaagctcagttgagtggatgcaaggatcattgttagcacaagcgccattgtcatggtatagggcatactttgatactccgactggtgacgaacctctggctctggatatgggtagcatgggaaagggccaaatctggataaatggacaaagcattggacggtactcgacatcatatgcaagtggggactgcaaagcttgcagttacgccggatcataccgggcacccaaatgtcaagcaggttgcggtcagcccacacaacgttggtatcatgtgccaaaatcctggttgcaaccatcaagaaatctattagttgtttttgaggaacttggtggggattcttcgaagatttcccttgtgaaaaggtcagtctcaagtgtatgcgctgatgtatccgagtatcatacgaacatcaagaactggcagattgagaatgcaggggaggttgagttccacaggccgaaggtgcatttaagatgtgcacctggtcagactatttctgccataaaatttgctagctttgggacacctcttgggacctgtggaaatttccagcaaggggattgccattcaactaagtcacacgctgttcttgagaagaactgcattgggcaacaaagatgcgccgtcaccatctcccccgataactttggtggagatccctgccctaaggagatgaaaaaggtggcagttgaggcggtgtgttctcctggtaca

SEQ ID NO: 4598 - DNA, 3215 bp, Festuca arundinacea
  misc_feature (1407)..(1407): n is a, c, g, or t
  misc_feature (1425)..(1425): n is a, c, g, or t
  misc_feature (1469)..(1469): n is a, c, g, or t
  misc_feature (1505)..(1505): n is a, c, g, or t
  misc_feature (1685)..(1685): n is a, c, g, or t
  misc_feature (1700)..(1700): n is a, c, g, or t
  misc_feature (1740)..(1741): n is a, c, g, or t
  misc_feature (1837)..(1837): n is a, c, g, or t
ggcacgagggctacgagcacccactgacgctcctaccaagaacctcgccaaggaatcctagaatccaagaaaggcatcaccacaaacaggggaaggaggagtctgaagcactcccagccagaagcaggagggtgtggagaccggtgaagaccacgcaaggcacaccacacttgccttgtgtgtgtcctgccgtgtggtcttcttctccgtctcctggtcctgccgccttcccctcggtgatggcgcggcgctggcctgctgcagcgctgctgctgctgctgctgctgggcctggccctggcggcggcggcggtgctggtggccgccgtggaaggcgcggtgacctacgacaagaaggcggtggtcatcaacggggagcggaagattctcttctccggatccatacattacccccggagcacccccgagatgtgggaaggcctgattcagaaggcgaaagacggaggcctggatgtgatccagacctatgtcttctggaacgggcatgaaccaactcaaggaaattacaatttcgaagggaggtacgatttggtcaagttcattaagaccgcccacaaggccgggctctttgtgcatctccgcatcggtccctacatctgcggggagtggaatttcggtggcttcccggtttggctcaagtatgttccgggcatcagcttcagaacggacaacgagcctttcaagacggcaatgcaggggtttaccgagaaaatcgtggggatgatgaagagtgaagagctctttgcttcccaaggtggccctattatcctttctcagattgagaatgaatatgggccagaagaaaaagagtttggggccgctggaaagtcatacagtaactgggcggcaaagatggccgtgggattggacaccggtgtgccgtgggtgatgtgcaagcaggatgacgccccggacccagtgataaatgcatgcaatggtttctactgtgatgcattttctccgaaccagccttacaagcctacaatgtggactgaagcttggaccggatggttcactgaatttggtgggaccatccgtaaacgtccggttgaagatctttcatttgctgttgctcgcttcgtacagaagggcggttcatttatcaactactacatgtatcacggaggaacaaattttgggcgcaccgctggaggtcccttcattaccacaagctatgattatgatgctccacttgatgaatatggacttgcaagagaaccaaagtatggacatcttaaagaactccatagagctattaagttatgtgagccggcattggtttctgttgacccagctgtgacttccctcggaagtatgcaagaggcccatgtctaccgttctccatctggttgtgcagcttttctcgcaaactacaattccaactctnatgcaaaagttgtcttcnacaatgagcattacagtcttccaccttggtcaatcagcatcctncccgattgcaaaactgttgtttttaacactgcaacngttggtgttcagacatctcaaatgcaaatgtgggcagatggggcctctacaatgatgtgggagaggtatgatgaagaggttggttcactggcagctgctccggtcctcacaacaactggtctgctggaacagcttaacgtaacaagagacaccagtgactatctttggtacatcaccagngtggatataaacccntctgagacgttcctacaaggtggcaagcccctgtctctcnntgtgcaatctgctggacatgcgttgcacatttttattaatggacagttgcaaggttctgcttctggaaccagggaagataaaagaatctcatacangggtgatgttaaccttcgtgcgggtagcaacaaaattgcactgctaagtgttgcttgcgggctgccgaatattggggtccattatgagacatggaatactggtgtcaacggtcctgttgtgcttcataggttggacgaaggttcacgagatctgacctggcagacttggtcctatcaggttggtctgaaaggtgaacaaatgaatctgaactccttagaaggtgcgggttcagttgaatggatgcaaggatcactggtagcacaaaaccaaatgccattgacatggtatagggcatactttgaaactccaagtggcgacgaatcactggctctggatatgggtagcatgggcaagggacaaatctggataaatggacaaagcattggacggtattcaacagcatatgcaactggggactgcaaagattgcagttacactgggtcattccgggcaacaagatgtcaatcaggttgtggtcagcccacacagcgttggtatcatgtgccaaaatcctggttgcaaccaactagaaatctattagttgtttttgaggaagttggtggtgattcttcgaagatttcccttgcaaagaggtcagtctcaagtgtctgtgctgatgtatcagagtttcatccggatatcaagaactggcagactgagaacgcaggggagcctgcccctgagttccacaagccaaaggtgcatttaagatgtgcagttgggcagtccatctctgccatcaaatttgcaagcttcggtacacctcttgggacctgtggaaatttcgagcaaggggagtgccatgcaactaagtcgcacactgttcttgagaaatgcattgggaaacaaagatgtgccgtcaccatctcccccgacaacttcggtggagatccctgccctaacatgatgaaaagggtggtagttgaggcggtatgttctcctggtacataggcagctccgtcgactaagactaatttaaagatggcgccgaaaaacgggtggtcttgtgcgtgatcaagcaagcacaaattgaagtggtgcgatgagagttcaattgtaaagtaccgatttcacgtagatgtggctggaggattagagggtcatttctattccgattcagattaggatttgtgctctgcggcatctccatgaattgttcagagtgaccaactgggtaattgaggttggtcctgggatggagtgcagggagagtaaaggcagaagatttgatgcgttcttttgcttacgtgttgggctgcctcatctttgttgaagaagaaagatgcaggtgaattgtgcaatgtacccttcttttgcattactggtgactagagaaacctttttagccacgcagtgagcataaatttgctgctgatc

SEQ ID NO: 4599 - DNA, 3026 bp, Triticum aestivum
  misc_feature (411)..(411): n is a, c, g, or t
  misc_feature (414)..(414): n is a, c, g, or t
  misc_feature (507)..(507): n is a, c, g, or t
  misc_feature (702)..(702): n is a, c, g, or t
  misc_feature (890)..(890): n is a, c, g, or t
  misc_feature (921)..(921): n is a, c, g, or t
  misc_feature (937)..(937): n is a, c, g, or t
  misc_feature (949)..(949): n is a, c, g, or t
gcacgaggtcttcttcttcctcctcctcaccgctcctccgaccatcttcccggacagcggggagcagggagtgatggcgcggcagtgggcggctgcgaccctgctgtgcctggccgtcttggcggcggcgtccgtgctggcggccgccgtggagggcgcggtccctacgaccggaaggcggtgctcatcaatgggcagaggagaatcctcttctccggatccatacattacccccggagcaccccagagatgtgggaagggctgattcagaaggcgaaagacggaggcttggacgtgatccagacctacgtcttctggaacgggcacgaaccaacccccggaaactacaacttcgaagggaggtacgatttggtcaagttcattaagacggcccagaaggccgggctgttngtncatctccgcatcggtccctacatttgcggagagtggaatttcggcggctttccggtctggctgaagtatgttccgggcatcagcttcaggacngacaacgagcctttcaaggcggcaatgcaggggttcaccgagaagattgtgggcatgatgaagagtgaggagctctttgcttcccaaggtggccctattatcctttctcagattgagaatgagtatgggccagaagagaaagagtttggggctgctggcaagtcatacagtgactgggcggcaaagatggccgtnggattggacaccggtgtgccgtgggtgatgtgcaagcaggaagatgcaccagatccagtgataaacgcatgcaatggtttctactgtgatgcatttacaccgaacacgccttcaaagcctacgatgtggactgaagcttggactggttggtttaccgaatttggtgggaccatccgtaaacgaccagntgaagatctttcatttgctgttgctcgcttngtgcagaagggtggtncttttatcaacnactacatgtatcatggtggaacaaattttgggcgcaccgctggaggtcccttcatcaccacaagctatgattatgacgctccacttgatgaatatggacttgcaagagaaccaaagtatggacatcttaaagaacttcatagagctattaagttatgtgagccggccttggtttctgttgatccaactgtgacttcccttggaagcatgcaagaggcccatgtctaccgatctccatctggttgtgcagcttttctcgcaaactataattctaactctcatgcaaaagttgtcttcgacaatgagcattatagtcttccaccttggtcaatcagcatccttcctgattgcaaaacagttgtttataacactgcaacggttggtgttcagacatctcaaatgcaaatgtggtccgatggggcctcttcaatgatgtgggagaggtatgatgaggaggttggttcactggcagctgctccgttgctcaccacaactggtctactggaacagcttaacgtcacaagagacaccagtgattatctttggtacatgaccagtgtggatgtaagcccctctgagaagtttctacaaggtggcaagcctttgtctctctctgtgcagtctgctggccatgccttgcatatctttatcaatggacagctacaaggctctgcttctggaaccagggaagataaaagaatctcatacaagggcaatgttaaccttcgtgccggtactaacaaaatatcactgctgagtgttgcttgtgggctaccgaatatcggggttcattacgagacatggaatactggtgtcaatggtcctgttgtgcttcatggtttggacgaaggttcgcgagatctgacctggcagacatggacctatcaggttggtctgaaaggtgaacaaatgaacctgaactccttagaaggtgcaagttcagttgaatggatgcaaggatcattgatagcacaaaaccaaatgccattggcatggtatagggcatactttgatactccaagtggtgatgaacctctggctctggatatgggtagcatgggtaagggacaaatctggataaatggacaaagcattggacggtactcattagcatatgcaactggggactgcaaagattacagttacactgggtcattccgggcaaccaaatgtcaagcaggttgcggtcagccgacacaacgctggtatcatgtgccaaaatcctggttgcagccatctagaaatctgttagttgttttcgaggaacttggcggggatacttcgaagatttcgcttgtgaagagatcagtgtcaagcgtctgtgctgatgtatcagagtttcatccaagtatcaagaactggcagactgagagctcaggggaagctaagcctgagttacacaggtcgaaggtgcatctaagatgcgcgcctgggcagtctatttctgccatcaaatttgcaagcttcgggacgccctctgggacttgcggaagtttcgagcaaggggagtgccattcgaccaagtcacagactgttcttgagaaatgcattgggaagcaaaggtgcgccgtcgccatctcccccgacaacttcggtggagacccctgcccggatgtgatgaagagggtggcggtcgaggcggtatgttctcccggtacataggcgactcttccgactagactaatttaaggacggcgcagcagccttgtgtgtgaccgatcaagcacatgggaagtgatgtggggaggtgagagttcaactgtaaagtactaccgactcgatgtagacgtggcgctggaggattagaattccatctctagcattgtgattcagattaggattggtgctctaccctgcatctccatgaattgttcaaaagcgaccagctggtaatttgtggttggtcctagatggagtgtagggagagtagaggcaaaagatcgatgcattcttttgctcgtgtcgtcgctatgttttggctgtgtcactgccatctttcttgaagaagagaagatgctgtatccttacttttgaaatacttgcttttaattgtgcatgctgtgagcatgaatatgctg

SEQ ID NO: 4600 - DNA, 1493 bp, Raphanus sativus
  misc_feature (289)..(289): n is a, c, g, or t
  misc_feature (1076)..(1076): n is a, c, g, or t
  misc_feature (1079)..(1079): n is a, c, g, or t
  misc_feature (1310)..(1310): n is a, c, g, or t
ggaaaacagcctcaaaggacatcgtgaaaaacataacacgatcgctttaaggctcaaagtcgagttcatcgaaagttttcagaccgaagctagagatggaagtttccggcgtcgttctccgacagattccgtgcgtctcaagctccgtcaccgatggccgttactccggtctccgattttccggcaacacgaggacgacgacggtcgggtttcggacgaggagattcagaggaatcacgtgtaataacgagttttccgataaagggcacatgagttactattctgggangacgacgagatgcggcggtgaggggaaggataaggtgaaggttatggagaaggagaagaagaaggagatgaagaagaaggctaaggttcttaaagctctttctaagaacttgaatatgttttcaagcatagggtttggtcttgatccggaagccggtttggtcgctgagattcaaaacaagacaatctcggaagcaacggagattctggttaagcagctggatcagttgaaagcagaggagaagctattgaagaaacagaggaaagaagaaaaggcaaaggctaaagctttgaagatgatgactgagatggactctgaatcttcttcttcttcgtctgaatctagtgacagtgattgtggcaaagggaaagttgttgacatgagctctttcagaaacaaggcgattctcgagccgttacgaccagagtctggagtagcaacccttcctagaatccaagaagattcttgcaagaacacaggtgaagcattgaagctcgctctgctgcaatcagctgctgcgtccacagcttttccctcagttgttaatcctggattgccattgaagacggtggaagcagttccggttgttggattgccgtcgaagagaatagaagtctgtatgggaggaaagtgcaagaaatcaggaggagctgtactgttagatgagtttcagaaggcgatgacgggcatggaaggatttgctgtggcatgcaagtgcatggggaagtgtagagatggtccaaacgttagagtggtgaacgagaccgatgctgtgatgactgattcngtnagaacaccttccaagaccgtttgtgtaggagttgggttgcaggatgtggaaactattgtcacaagtttttttggtgaataatgcaggagagaaggttttggatcatgcctcgtatggaaagtgtttaaacatatgatcaaattgatataatgcatagtgtggtgttctttttctcattgtacataaatgtcttcgtgtgcattttcgagtggaacattggtaatataaacntcttttctgtactttggtcttgacaaagaaacctatgttgcataaggctaacgatccaatattgtactggattgtacaactagtgatcatttatttgcatgcacttaactacataatggtcctaacgatcatgtgttgctgcaagcaacgaaaatacagatgggatttcaattttttgtgcta

SEQ ID NO: 4601 - DNA, 1319 bp, Raphanus sativus
  misc_feature (152)..(152): n is a, c, g, or t
  misc_feature (270)..(270): n is a, c, g, or t
  misc_feature (921)..(921): n is a, c, g, or t
  misc_feature (1237)..(1237): n is a, c, g, or t
aaacagcctcaaaggacatcgtgaaaaacagaacacgatcgctttaaggctcaaagtcgagttcatcgaaagttttcagacagaagctagagatggaagtttccggcgtcgttctccgacagattccgtgcgtctcaagctccgtcaccganggccgttactccggtctccgattttccggcaacacgaggacgacgacggtcgggtttaggacgaggagattcagagggatcacgtgtaataacgagtttgccgataaagggcacatgngttactattctgggacgacgacgacgagatgcggcggtgaggggaaggataaggtgaaggttatggagaaggagaagaagaaggagatgaagaagaaggctaaggttcttaaagctctttctaagaacttgaatatgttttcaagcatagggtttggtcttgatccggaagccggtttggtctctgagattcagaacaagacgatctcggaagcgacagagattctggttaagcagctggatcagttgaaatcagaggagaagctattgaagaaacagaggaaagaagaaaaggcaaaagctaaagctttgaagatgatgactgagatggactctgaatcttcttcttcttcgtctgaatcaagtgacagtgattgtgggaaagggaaagttgttgacatgagctctttcagaaacaaggcgattctcgagccgttacaaccagagtctggagtagcaacccttcctagaatccaagaagattcttgcaagaacaccggtgaagcattgaagctcgctctgctgcaatcagctgctgcgtctacagcttttccctcagttgttaatcctggattgccattgaagacggtggaagcagttccggttgttggattgccgtcgaagagaatagaagtctgtatgggaggaaagngcaagaaatcaggaggagctgtgttgttggatgagtttcagaaggcgatgacggggatggaaggatctgctgtggcttgcaagtgcatggggaagtgtagagatggtccaaacgttagagtggtgaacgagaccgatgctgtgatgactgattcagttagaacaccttccaagaccgtttgtgtaggagttgggttgcaggatgtggaaactattgtcacaagtttttttggtgaataatgcaggagagaaggttttggatcatgcctcgtatggaaagtgtttaaacatatgatcaaattgatatatgcatagtntggtgttctttttctcattgtacataaatgtcttcgtgtgcattttcgagtggaacattgataatataaacctcttttctgt

SEQ ID NO: 4602 - DNA, 1320 bp, Arabidopsis lyrata
atggaagtttccggcgtcgttctccgacaaattccatgtgtttcttcaggttctgttgcctgtctccgattagtgtcggagttttccggtaatacgagaacggtagggtttcgaaccaagaaatttcgtgggattgtgtgtaataatgagtttgcggataaagggcacatgagttactatatcgagccaacgagatgcggcgaggagaaagaaaaggttaaggttatggagaaggagaagaaggcgttgaagaagaaggaaaaggttcttaaaagtctttctaagaacttgaatatgttctcaagtatagggtttggtcttgatcctgaagctggtttggttggtgagattcagaccaagacaatctcggaagcaacagagatattggttaagcagctggagcagttgaaagcagaggagaagctattgaagaaacagaggaaagaagaaaaggcaaaagccaaagctatgaagaagatgactgaaatggactctgaatcatcttcttcctctgaatcaagtgatagtgatcgtgataaaggcaaagttgttgacatgagctctctcagaaacaagactaaaccggttcttgagccgttacaaccagaagccacagtagcaacccttcctagaatccaagaagatgcacaatcttgcaagaacaccagtgaagcattgcagattgctctgcaaacatccacagtatttccctcaatgcccaatcctgtacagacattgaagacggtagaagcggtttcagtggttggattaccattgaagagagtagaagtatgtatgggagggaagtgtaagaaatcaggaggagctttgttgttggatgagttccaaagggcgatgacgggtttccaaggttccgctgtggcttgcaagtgcatggggaagtgtcgtgatggtccaaacgttagagtcgtcaacgagactgatagtgtgatgactgattcagttaggacaccgtccaagaccgtttgtgtaggagttggattgcaggatgtggaaactatcgtgacaagtttctttgatgaagaatgtagcagggagggactcggttatgtctcacattgaagtgtttaaaaatgacttaaaagtgatatatagtgtggtgctttctctcattgtagatatctgtcttctggaaacgttgaaataaataaacgttgatataaatcttttgcgttaagacctgtaaagatcagcttaatcagaaacatctataagatacaagccctaacgatcaattatctagaagctacactactaaagaccatttgtttgcaccaaactattacaaatgatcatttt

SEQ ID NO: 4603 - DNA, 1518 bp, Brassica juncea
gtttccggagtgaatgagaaaatgagaataagtctttttttttacatagagatgtttatgttatcaatgttccatgcacacgaagacaggtaatgtacaatgagaaaaaacatcacaactatgcatataccactttgatcattataagctctttcaatatgttacataatcaagaccttctccgctacattattcaccaaaaaaacttgtgacaatagtttccacatcctgcaacccaactcctacacaaacggtcttggaaggtgttctaactgaatcagtcatcacagcatcttcagtctcgttcaccactctaacgtttggaccatctctacacttccccatgcacttgcaacccactgcagatccttccatccccgtcattgccttctgaaactcatccaacaacacagctcctcctgatttcttgcactttcctcccatacagacttctattctcttcgacggcaatccaacaactggaactgcttccaccgtcttcaatggcaatccaggattaacaactgagggaaaagctgtggtcgcagcagctgattgtagcagagcgagcttcaatgcttcacccgtggtgttcttgcaagaatcttgttggattctaggaagggttgctactccagattctggttgtagtggctcaagaatcggtttagccttgtttctcaaagagctcatgtcaacaaccttccctttgtcacaatcactgtcacttgattcagaggaagaagacgattcagagtccatttcagtcatcatcttcatggctttagcctttgccttctcttccttcctctgtttcttcaaaagcttctcctctgctttcaactgatccagctgcttaaccagaatctctgttgcttccgagattgtcttgttttgaatctcagcaaccaaaccggcatctggatcaagaccaaaccctatgcttgaaaacatgttcaagttcttggaaagagctttaagaaccttagccttcttcttcatgtccttcttcttctccttctccataaccttcaccttatccttcctccgccgccgctctccgccgatccgccgtcgtctggttccgtaacgacctccgcgtccacgacaatgagtgtctcaactccgccaacgacgagtgcgtctccgttttgcccgtctactgcttcgaccctcgtgactacggaaaatcctcctctggtttcgacaaaacgggtccgtttcgtgctcagtttctgatcgagtccgtctccgagctccggaagaatctcgaggccagggggtcgaacctcgtcgtcagggtcgggaaaccggaagctgttctggtggaattggctaaggagatcggagcagacgcgatttacgctcacagggaagtgtctcacgacgaggttaaggcggaagggaagatagagagtgctatgaaggaggaaggcgttgaagttaagtacttttggggaagcactctctatcatttagacgacttgcctttcaaagttgaagacttgccttctgaac

SEQ ID NO: 4604 - DNA, 1440 bp, Thellungiella halophila
  misc_feature (53)..(54): n is a, c, g, or t
gactggaaatctcccacaacaaggaacagccttaaggatttcgtgtatctaanngatcgcttaaggctcaagtcaagttcattgatttctagcttccaaattcgaaagtcaatcgtctaagcttcagagacaagagacatggaagtttccggcgtcgttctccgacaaattccttccgtttcaggtgccgttgccgatggccgttactccggtctccgatcggtgtccaaattttccggcaattcacgcacggtgtcgtttcaaaccaggaaatttcacggggttatgtgtaataacgagtttgcggataaagagcacatgaattactatttcaagccaacgagatgcggcggagagaaggagaaggttaagcttatggagaaggagaagaaggcgttgaagaagaaagctaaggtccttaaaagtctttctaagaacttaaacatgttctcaagcatagggtttggtcttaatccagaagccggtttggtttctgagattcagaacaagtcaatctcggaagcaacagagattttggttaagcagctagagcagttaaaagcagaggagaagctattgaagaaacaaaggaaagaagaaaaggcaaaagctaaagccatgaagatgactactgacatggactctgaatcatcatcatcttcgtctgaatcaagtgacagtgattgtggcaaaggaaaagttgttgacatgaacactctcagaaacaaggagaaaccgattcttgagccgttacagccagaatctactttagcaacccttcctaggatccaagagactctgatttctaataagaagctcgaagaagatgcacagatcacaggcgaagcattgcagcttgctctgcttcaatcagctgctgcgtccacagtctttcccttaatggcaaatcctggacagagattgaagacagtagaagcggtttcagtggttggattgccattgaagagagtagaagtgtgtatgggaggaaagtgtaagaaatcaggaggagctgtgttgttaaatgagtttcaaagggccatgacgggcatggaaggatccgctgtggcttgcaagtgcatggggaagtgtcgagatggtccaaacgttagagttgtgaacgagacttatgattctatgatgactgattcagttaagacaccgtccaagaccgtttgtgtaggagttggattgcaggatgttgaaactattgtcacaagtttctttggtgaagaatctagcagagagggactcggttatgtctcttattgaaagtgttcttaactgaccaaagatatatatatatatatatatatatagtgttatagtgtgatgttttctctcattgtacatatctgtcttcttatgcatctttgagtgtaacattgatatatttatcttactgtactttggtttgaaaagaaaatctgttgcgataag

SEQ ID NO: 4605 - DNA, 1458 bp, Arabidopsis thaliana
ctcactgttaaattctctcctgtaaaagaactggcaaatctccctcaacaaagaacttagccttaaaggatttgtataacaaatattatcgtaatcgcttaaggctcaagtcacacaagttcattgattccacctttctaattacgaggatggaagtttccggcgtcgtcctccgacaaattccatgtgtttcttcaggttccgttgcaggtctccgattagtatcggaattttccggtaataccagaacggtagggtttcgaaccagaagatttcgtggtattgtgtgtaataatgagtttgcggataaagggcatgtgaattactatatcgagccaacgagatgcggcgaggagaaagagaaggttaaggttatggagaaggagaagaaggcgttgaagaagaaggcgaaagttcttaaaagtctttctaagaacttggatatgttctctagtatagggtttggtcttgatcctgaagctggtttggttggtgagattcagaccaagacaatctcggaagctacagagatattggttaagcagctggagcagttgaaagcagaggagaagatattgaagaaacagaggaaagaagagaaggctaaagccaaagccatgaagaagatgactgaaatggactctgaatcatcttcttcgtctgaatcaagtgatagtgattgtgataaaggcaaagttgtggacatgagctctttaagaaacaaggctaaaccggttcttgagccgttacaaccagaagccacagtagcaacccttcctaggatccaagaggatgcaatttcttgcaagaacaccagtgaagcattgcagattgctctacaaacatccacaatttttccttcaatggccaatcctggacagacattgaagacggtagaagcggtttcagtggttggattaccattgaatagagtagaagtgtgtatgggagggaagtgtaagagatcaggaggagctttgttgttggatgagtttcaaagggcgatgacgggtttcgaaggatctgctgtggcttgcaagtgcatggggaagtgtcgtgatggcccaaacgttagagttgtgaaggagactgatgctgtgatgactgattcagttaggacaccatccaagaccctttgtgtaggagttggattgcaggatgtggaaactattgtgacaagtttctttgatgaagaatgtagcagagaaggactcggttctgtctcatattgaaagtgttttgaaacggctaatgttttatatagtgtggtgctttctcattgtacatatttaccttctcgataagtcattgatataagccatgtaattgcgataagacctgtaaagatcaacttaagcaaaaacatctgcaagatacaagcctaacgatccatttatcttgaaactacactacgaaagatcatttgtttgcaataaaatattacaaatgatattttta

SEQ ID NO: 4606 - DNA, 1308 bp, Brassica rapa
gaagtgatataatttgattattgttctctacacagcaatatgtgagaaaagaaaatgcttatagatagatgcatttatataaatgagcctcagaaaatgaaagtactcacgagtacatttggtactcaccaaaacgtatttgaagaagagacaatttccaaaagtgaaaaaaaaaaattcaaaagttttggacattttatttgtcaaaagaataataattcatgatgttcccacaccaccattggttgatagatttcactaagcagtagcttccttcaagtaggcgatgagatcagcgcgatcttgtggcttcttgagcccagggaagaccatctttgttccaggaatgtacttcttgggattgagcaagtaatcgtacaaggtcttctcttcccattcaacagccttgttcttgttagccgcagagtaagagtaaccggctgttgttccagactgccttccaaacagcccgtttaggttcggtccttgtttgtgaccggcgcctttgtcgacggtgtgacactgagcgcacttggttctgaagatcttttcaccggccttggagtttcctggtggtgcttcatcgaacgacgccattttcgctggggagaaaattaagacggaactcgcttctctttagggtttgtttaccattttcccactttcctttgagaaaacagagcaaaatggcactgagaatgtgggcttcctctacagcaaacgctctcaagctctcttcttctgcctccaaatctcatcttcttccagctttctccatctccagatgcttctcctcagtgttggaaggactcaagtatgcaacttcacacgagtgggtgaaacatgatggctcggtggctaccattggcatcactgaccatgcccaggaccatctaggagaagttgtgtttgtggagctgccagaagagaaaagctcagtgagcaaagaaaagaactttggagctgtggagagtgtgaaggcaacaagtgagattctatctccaatctctggtgaagtcattgaggttaacacaaagctaaccgattcacctggtttgatcaactcaagcccctatgaagatggttggatgataaaggtgaaaccaagcaaccctgcagagttggaaaccttgatgggttcaaaggaatacaccaagttctgcgaagaggaagatgctgctcactagagggtttcacctgtctatgtttcgtaccctatctctctcagctttgtatctctgtaatactaatttggttgaaagatgatcattcaaataagactcaagagagcttttaactctaaacaac

SEQ ID NO: 4607 - DNA, 675 bp, Raphanus sativus
gtctctttgccatttccccactttcctttgagaaaagaaagcaaaatggcactgagaatgtgggcttcctctacagcaaacgctctcaagctctcttcttctgcctccaaatctcatctccttccggctttctccatctctagatgcttctcctcagtgttggaaggacttaaatatgcaaattcacatgagtgggtgaaacatgatggctcagtggctaccataggcatcactgaccatgcccaggatcatttaggagaagttgtgtttgtggagctgccagaagagaaaagctcagtgagcaaagaaaagaactttggagctgtggagagtgtcaaggccacaagtgagattctatctccaatctctggtgaagtcgttgaggttaacacaaagctcaccgattcgcctggtttgatcaactcaagcccttatgaagatggttggatgataaaggtgaaaccaagtaaccctgcagagttggaaaccttgatgggctcaaaggaatacaccaagttctgcgaagaggaagacgctgctcactagagggatttcaatctcacttcacttgtcaatgttccttaccctatctctctcagctttgtatctctgtaatactaatttggttgaaagatgatatcattcaaataagactcaagagagcttttaacttta

SEQ ID NO: 4608 - DNA, 735 bp, Brassica juncea
ggttttttttttgtgccatacgtctaaagatagcacacaaaagttaataaaatccactaagagagctctctttgccattttcccactttcctttgagaaaacagagcaaaatggcactgagaatgtgggcttcctctacagcaaacgctctcaagctctcttcttctgcctccaaatctcatctccttccagctttctccatctccagatgcttctcctcagtgttggaaggacttaagtatgcaaattcacacgagtgggtgaaacatgatggctcagtggctaccattggcatcactgaccatgcccaggaccatttaggagaagttgtgtttgtggagctgccagaagagaaaagctcagtgagcaaagaaaagaactttggagctgtggagagtgtcaaggccacaagtgagatcctatctccaatctctggtgaagtcattgaggttaacacaaagctcaccgattcacctggtttgatcaactcaagcccatatgaaggtggttggatgataaaggtgaaaccaagcaaccctgcagagttggaaaccttgatgggtccaaaggaatacaccaagttctgcgaagaggaagacgctgctcactagaagggatttcaacctttcaacttgtcaatgtttcgtacccaatctctctcagccttgtatcatctctgtaatactaatttggttgaaagatcattcaaataagactcaacagagcttttaactt

SEQ ID NO: 4609 - DNA, 1343 bp, Brassica juncea
ggcactgagaatgtgggcttcctctacagcaaacgctctcaagctctcttcttctgcctccaaatctcatctccttccagctttctccatctccagatgcttctcctcagaaggacttaagtatgcaacttcacacgagtgggtgaaacatgatggctcagtggctaccattggcatcactgaccatgcccaggaccatttaggagaagttgtgtttgtggagctgccagaagagaaaagctcagtgagcaaagaaaagaactttggagctgtggagagtgtcaaggccacaagtgagatcctatctccaatctctggtgaagtcattgaggttaacacaaagctcaccgattcacctggtttgatcaactcaagcccctatgaagatggttggatgataaaggtgaaaccaagcaaccctgcagagttggaaaccttgatgggtccaaaggaatacaccaagttctgcgaagaggaagatgctgctcactagaagggatttcaacctttcaacttgtcaatgtttcgtacccaatctctctcagccttgtatcatctctgtaatactaatttggttgaaagatcattcaaataagactcaacagagcttttaactttaaacaacacaaataagtaaaacttccaatcatacagttgatgcaagaaaacattaagaccaaaccaaagttgtatgcataaagactttgatctgtacagtcactcctatcaggcaccgttgggcaaggtcggagaaacagttacatcaggtgagggagacggtgactcgtcgtaggagatggagatcagctcagatctgagcttttccgcgacttcagagttcgttttggtgactccgtttgtggtactgacgacaggtttcacatctgagggcgttagagagtcttctacctcctccggcgaagtgtaggagatagcgatgagagactcacgagcttgttcttgagagatatcgttactgggttgttccatcaaacaatcaaatgcctttacaagcttctcgtggattcggacggcaattgcaaacggaaagttcagagaccccctcacctgatgtacctgctgtttctccgaccttgcccaacggtgtctgatataagataactgtacagatcaaagtctgttccttttccatgcgtacaactttggtttggtctaaaaagtagaccattgtgatatcttaacgttttctttcatgaactgtatgataagtttttcttatttgtgttgtttaaagttaaaagctctcttgagtcttatttgaatgatcaaaaaaaaacatgatgaccaaagctaatccaagtttcaatgtctcgacttgcaat

SEQ ID NO: 4610 - DNA, 740 bp, Thellungiella halophila
gattaagaagctcacattaccattttcccactttcctttgagaaaacagaacaaacgaaaaagaaagaaaccagaaaagaatggcactgagaatgtgggcttcctctacagcaaacgctctcaagctctcttcttctgcctccaaatctcatctccttccagctttctccatctccagatgcttctcctcagtgttggaaggacttaagtatgcaaattcacatgagtgggtgaaacatgaaggctctgtggctaccattggcattactgaccatgcccagggccatttaggagaagttgtgtttgtggagctgccagaagaaaaaagtgcagtgagcaaagaaaaaaactttggagctgtggagagtgtgaaggccacaagtgagattctatctccaatctctggggaagtcattgaggttaacacaaagctcaccgattcacctggtttgatcaactcaagcccttatgaagatggttggatgataaaggtgaaaccaagcaaccccgcagagttggaatccttgatgggtccaaaggagtacaccaagttctgcgaagaggaagacgctgctcactagagagttgaatgtcctgaacaaaagagcaaaacaagagaatccatgctaaagtttcaatctttcacttctgatgtttcttacttctatcagcttgtatctctgtgatactaatttggtttaaagatcattcaatgagactcaagagagctttaaataata

SEQ ID NO: 4611 - DNA, 746 bp, Brassica juncea
gagctctctttaccatcttcccacttccctttgagaaagaaaacagaacaaagaaaaagaaagaaagcaaacagaaaaaatggcactgagaatgtgggcttcctctacagcaaacgctctcaagctctcttcttctgcctccaaatctcatctccttccagctttctccatctccagatgcttctcctcagtgttggaaggacttaagtatgcaaattcacatgagtgggtgaaacatgaaggctcagtggctactattggcatcagtgaccatgcccaggatcatttaggagaagttgtgtttgtggagctgcctgaagaaaaaagttcagtgaccaaagagaaaaactttggagcagtggagagtgtgaaggcaacaagtgagattatatctccaatctctggtgaagtcattgaggttaacacaaagctcgctgattcacctggcttgatcaactcaagcccttacgaagatggttggatgataaaggtgaaaccaagcaaccctgcagagctggaatccttgatgggttcaaaggaatacaccaagttctgcgaagaggaagacgctgctcactagagggtttcttcgtctttcccagtatgtcctaaacaaaaagcaagacaagagaatccatgctaaagtttcaatcttttcactacttctcaatgtttcctacctctgtatcaaatttgtatctctgtaatactgttttggttaaaaatcattcgatgagagctttaac

SEQ ID NO: 4612 - DNA, 773 bp, Brassica napus
  misc_feature (619)..(619): n is a, c, g, or t
atacatctaaagatagaaagcacaaaagccattaagagctctctttaccattttcccccacattactttgagaaaacaagaaagacatggcactgagaatgtgggcttcttccacagcaaacgctctcaagctctcctcttctgcttccaaatcccatctccttccagctttctccatctccagatgcttctcctcagtgttggaaggactcaagtatgcaaattcacatgagtgggtcaaacatgaaggctcagtggctaccattggcatcagtgaccatgcccaggaccatttaggagaagttgtgtttgtggagctgccagaagagaaaagttcagtgagcaaagaaaaaaactttggagcagtggagagtgtaaaggccacaagtgagattctatctccaatctctggtgaagtcattgaggttaacacaaagctcgccgattcacctgggttgattaactcaagcccctatgaagaaggttggatgataaaggtgaaaccaagcaacccagcagagttggaatccttgatgggtccaaaggaatacaccaagttctgcgaagaggaagacgccgctcactagaggattcagagcaaaacaagagaaaccatgcntaaagtttcagttattttttcacttgtcaatgtttttttacatctctctcagcttgtatcagtggtgatataccaatttgattaagatcatgctatgagactcagctgagctttattaaattttaaataagagtggtctaataagcacacaagg

SEQ ID NO: 4613 - DNA, 685 bp, Brassica juncea
aagagctctctttctttaccattttccccacattactttgagaaaacaagaaagacatggcactgagaatgtgggcttcttccacagcaaacgctctcaagctctcctcttctgcttccaaatcccatctccttccagctttctccatctccagatgcttctcctcagtgttggaaggactcaagtatgcaaattcacatgagtgggtcaaacatgaaggctcagtggctaccattggcatcagtgaccatgcccaggaccatttaggagaagttgtgtttgtggagctgccagaagagaaaagttcagtgagcaaagaaaaaaactttggagcagtggagagtgtaaaggccacaagtgagattatatctccaatctctggtgaagtcattgaggttaacacaaagctcgccgattcacctggtttgattaactcaagcccctacgaagaaggttggatgataaaggtgaaaccaagcaacccagcagagttggaatccttgatgggtccaaaggaatacacaaagttctgcgaagaggaagacgcggctcactagaggattcagagcaaaacaagagaaaccatgcttaaagtttcagttattttttcacttgtcaatgtttctttacatctctctcagcttgtatcagtggtgatataccaatttgattaagatcttgctat

SEQ ID NO: 4614 - DNA, 670 bp, Brassica oleracea
aataaaacagaacgaaaacaagaaagaaaccagaaccaaaatggcactgagaatgtgggcttcctctacagcaaacgctctcaagctctcttcttctgcctccaaatctcatctccttccagctttctccatctctagatgcttctcctcagtgttggaaggacttaaatatgcaaattcacatgagtgggtgaaacatgaaggctcagtggctactattggcatcagtgaccatgcccaggatcatttaggagaagttgtgtttgtggagctgcctgaagaaaaaagttcagtgaccaaagagaaaaactttggagccgtggaaagtgttaaggcaacaagtgagattatatctccaatctctggtgaagtaatcgaggttaacacaaagctcgctgattcacctggcttgatcaactcaagcccttacgaagatggatggatgataaaggtgaaaccaagcaaccctgcagagctggaatccttgatgggtccaaaggaatacaccaagttctgcgaagaggaagacgctgctcactagggtttcttcgtctttcccagtcctctgtatcaaatttgtatctctgtaatactgttttggttaaaaatcattcgatgagtctcaagagagctttaactaagaataacacagagaagaaaaactttcgtc

SEQ ID NO: 4615 - DNA, 763 bp, Brassica napus
atacatctaaagatagaaagcacaaaagccattaagagctctctttaccattttcccccacattactttgagaaaacaagaaagacatggcactgagaatgtgggcttcttccacagcaaacgctctcaagctctcctcttctgcttccaaatcccatctccttccagctttctccatctccagatgcttctcctcagtgttggaaggactcaagtatgcaaattcacatgagtgggtcaaacatgaaggctcagtggctaccattggcatcagtgaccatgcccaggaccatttaggagaagttgtgtttgtggagctgccagaagagaaaagttcagtgagcaaagaaaaaaactttggagcagtggagagtgtaaaggccacaagtgagattatatctccaatctctggtgaagtcattgaggttaacacaaagctcgccgattcacctggtttgattaactcaagcccctatgaagaaggttggatgataaaggtgaaaccaagcaacccagcagagttggaatccttgatgggtccaaaggaatacacaaagttctgcgaagaggaagacgcggctcactagaggattcagagcaaaacaagagaaaccatgcttaaagtttcagttattttttcacttgtcaatgttttttacatctctctcagcttgtatcagtggtgatataccaatttgattaagatcatgctatgagactcagctgagctttattaaattttaaataagagtggtctaataag

SEQ ID NO: 4616 - DNA, 705 bp, Zea mays
ttactttgagaaaacaagaaagacatggcactgagaatgtgggcttcttccacagcaaacgctctcaagctctcctcttctgcttccaaatcccatctccttccagctttctccatctccagatgcttctcctcagtgttggaaggactcaagtatgcaaattcacatgagtgggtcaaacatgaaggctcagtggctaccattggcatcagtgaccatgcccaggaccatttaggagaagttgtgtttgtggagctgccagaagagaaaagttcagtgagcaaagaaaaaaactttggagcagtggagagtgtaaaggccacaagtgagattatatctccaatctctggtgaagtcattgaggttaacacaaagctcgccgattcacctggtttgattaactcaagcccctatgaagaaggttggatgataaaggtgaaaccaagcaacccagcagagttggaatccttgatgggtccaaaggaatacacaaagttctgcgaagaggaagacgcggctcactagaggattcagagcaaaacaagagaaaccatgcttaaagtttcagttattttttcacttgtcaatgtttctttacatctctctcagcttgtatcagtggtgatataccaatttgattaagatcatgctatgagactcagctgagctttattaaattttaaataagagtggtctaataagccc

SEQ ID NO: 4617 - DNA, 882 bp, Arabidopsis thaliana
aaagtttgggtcacacttttttcgacgacaacattaagatgaggcctttgttttctgccatacatctaaagatagaacacaaacgtcaataaaagcaattaagatctctctttactgttttcccacttttcctttgagaaaactcaaaacaaagtaaacaaacaaaccagaaaaaggaatggcactgagaatgtgggcttcctctacagcaaatgctctcaagctctcttcttctgcctccaaatctcatctcttgccagctttctccatctccagatgcttctcctcagtgttggaaggacttaagtatgcaaattcacatgagtgggtgaaacatgaaggctcagttgctacaattggtatcactgaccatgcgcaggaccatttaggagaagttgtgtttgtggagctgcctgaagcaaacagttcagtgagcaaagaaaaaagctttggagctgttgagagtgttaaggccacaagtgagattctatctccaatctctggtgaagtcattgaggttaacacaaagctcaccgagtcacctggtttgatcaactcaagcccttatgaagatggttggatgataaaggtgaaaccgagcagccccgcggagttggaagctctgatgggtccaaaggaatacaccaagttctgcgaagaagaagacgctgctcactagggtttcttcgccttttatctttcccaaatgttcgaaaaacagagcaaaacaagagaatccatgctttagtttcaatctttcatttctcaatgtttcttaccactctcaacttgtatcagtgtgatactaatttgattaaaagatcatccaatgagactcatcagagcttttaactttatataagacaggtcaaacaagcacac

SEQ ID NO: 4618 - DNA, 854 bp, Arabidopsis thaliana
aaagtttgggtcacacttttttcgacgacaacattaagatgaggcctttgttttctgccatacatctaaagatagaacacaaacgtcaataaaagcaattaagatctctctttactgttttcccacttttcctttgagaaaactcaaaacaaagtaaacaaacaaaccagaaaaaggaatggcactgagaatgtgggcttcctctacagcaaatgctctcaagctctcttcttctgcctccaaatctcatctcttgccagctttctccatctccagatgcttctcctcagtgttggaaggacttaagtatgcaaattcacatgagtgggtgaaacatgaaggctcagttgctacaattggtatcactgaccatgcgcaggaccatttaggagaagttgtgtttgtggagctgcctgaagcaaacagttcagtgagcaaagaaaaaagctttggagctgttgagagtgttaaggccacaagtgagattctatctccaatctctggtgaagtcattgaggttaacacaaagctcaccgagtcacctggtttgatcaactcaagcccttatgaagatggttggatgataaaggtgaaaccgagcagccccgcggagttggaagctctgatgggtccaaaggaatacaccaagttctgcgaagaagaagacgctgctcactagggtttcttcgccttttatctttcccaaatgttcgaaaaacagagcaaaacaagagaatccatgctttagtttcaatctttcatttctcaatgtttcttaccactctcaacttgtatcagtgtgatactaatttgattaaaagatcatccaatgagactcatcagagcttttaact

SEQ ID NO: 4619 - DNA, 657 bp, Brassica oleracea
  misc_feature (340)..(340): n is a, c, g, or t
  misc_feature (630)..(630): n is a, c, g, or t
  misc_feature (641)..(642): n is a, c, g, or t
ctttgagaaaacaagaaagacatggcactgagaatgtgggcttcttccacagcaaacgctctcaagctctcctcttctgcttccaaatcccatctccttccagctttctccatctccagatgcttctcctcagtgttggaaggactcaagtatgcaaattcacatgagtgggtcaaacatgaaggctcagtggctaccattggcatcagtgaccatgcccaggaccatttaggagaagttgtgtttgtggagctgccagaagagaaaagttcagtgagcaaagaaaaaaactttggagcagtggagagtgtaaaggccacaagtgagattatatctccantctctggtgaagtcattgaggttaacacaaagctcgccgattcacctgggttgattaactcaagcccctatgaagaaggttggatgataaaggtgaaacctagcaacccagcagagttggaatccttgatgggtccaaaggaatacaccaagttctgcgaagaggaagacgccgctcactagaggattcagagcaaaacaagagaaaccatgcctaaagtttcagttattttttcacttgtcaatgtttctttacatctctctcagcttgtatcagtggtgatataccantttgattaagnncatgctatgagactc

SEQ ID NO: 4620 - DNA, 1084 bp, Brassica rapa
cccacgcgtccgactaagagctctctttaccatcttcccacttccctttgagaaagaaaacagaacaaagcaaaagaaagaaagcaaacagaaacaaatggcactgagaatgtgggcttcctctacagcaaacgctctcaagctctcttcttctgcatccagatctcatctccttccagctttctccatctccagatgcttctcctcagtgttggaaggacttaagtatgcaaattcacatgagtgggtgaaacatgaaggctcagtggctactattggcatcagtgaccatgcccaggatcatttaggagaagttgtgtttgtggagctgcctgaagaaaaaagttcagtgaccaaagaaaaaaactttggagcagtggagagtgtgaaggcaacaagtgagattatatctccaatctctggtgaagtcatcgaggttaacacaaagctcgctgattcacctggcttgattaactcaagcccttacgaagatggttggatgataaaggtgaaaccaagcaaccccgcagagctggaatccttgatgggtccaaaggaatacaccaagttctgcgaagaggaagacgctgctcactagggtttcttcgtctttgtcctaaacaaaaagcaaaacaagagaggacccatgctaaatgtttcaatcttttcactacttctcaatgtttcctacctctgtatcaaatttgtatctctgtaatactgttttggttaaaaatcgttcggtgagtctcaaaaaaaaataacgacggccgattatttaggtttcctctgcgcattgaaatataattcgtcgctgatcagaatcatatcgagaggcaactacacttgcgacccaagcaaaacgtactccgtcgctgatctaaactatccgtcgtttgccgttaacgtcgacgggtccagcacgtacaagtacacacgcacggtcacaaacgttggaggagctgggtcatactcggttaaagtaacgtcggagacaacagcagtcaagatttcggttgaaccggcgattttgaattttaaagaagtgaacgagaagaaatcttatgaggtaacgtttaccgtt

SEQ ID NO: 4621 - DNA, 770 bp, Brassica rapa
atacatctaaagatagaaagcacaaaagctattaagagctctctttaccatttttccccacattactttgagaaaacaagaaagacatggcactgagaatgtgggcttcttccacagcaaacgctctcaagctctcctcttctgcttccaaatcccatctccttccagctttctccatctccagatgcttctcctcagtgttggaaggactcaagtatgcaaattcacatgagtgggtcaaacatgaaggctcagtggctaccattggcatcagtgaccatgcccaggaccatttaggagaagttgtgtttgtggagctgccagaagagaaaagttcagtgagcaaaggaaaaaactttggagcagtggagagtgtaaaggccacaagtgagattatatctccaatctctggtgaagtcattgaggttaacacaaagctcgccgattcacctggtttgattaactcaagcccctacgaagaaggttggatgataaaggtgaaaccaagcaacccagcagagttggaatccttgatgggtccaaaggaatacacaaagttctgcgaagaggaagacgcggctcactagaggattcagagcaaaacaagagaaaccatgcttaaagtttcagttattttttcacttgtcaatgtttctttacatctctctcagcttgtatcagtggtgatataccaatttgattaagatcatgctatgagactcagctgagctttattaaattttaaataagagtggtctaataagcaaaaa

SEQ ID NO: 4622 - DNA, 1194 bp, Brassica napus
gacccacgcgtccgaaataaaatccactaagacctctctttaccattttcccactttcttttgagcaataaaacagaacgaaaacaagaaagaaaccagaaccaaaatggcactgagaatgtgggcttcctctacagcaaacgctctcaagctctcttcttctgcctccaaatctcatctccttccagctttctccatctctagatgcttctcctcagtgttggaaggacttaaatatgcaaattcacatgagtgggtgaaacatgaaggctcagtggctactattggcatcagtgaccatgcccaggatcatttaggagaagttgtgtttgtggagctgcctgaagaaaaaagttcagtgaccaaagagaaaaactttggagccgtggaaagtgttaaggcaacaagtgagattatatctccaatctctggtgaagtaatcgaggttaacacaaagctcgctgattcacctggcttgatcaactcaagcccttacgaagatggatggatgatgaaggtgaaaccaagcaaccctgcagagctggaatccttgatgggtccaaaggaatacaccaagttctgcgaagaggaagacgctgctcactagggtttcttcgtctttcccagtatgtcctaaacaaaaagcaaaacaagagaatccatgctaaaagtttcaatcttttcactacttctcaatgtttactacctctgtatcaaatttgtatctctgtaatactgttttggttaaaaatcattcgatgagtctcaagagagctttaactaagaataacacagagaacaaaaactttcgtcaattttcaatcatatatagttgaagagggtctaactttcaaacaaaaccaaagtcgtctgcatgagaaaggaaaagactttgatctgtacaattactcctatcagacagctacagctggtgagggtgagggtgaaggtgactcgtcgtaggagatggaaatcagctcagacctgagcttttccgcatcttcagagtttcttttagtgacgagtccgtttgttggtttcatatcagaggtcgttatagactcttgctcctcttcaggtgaagtgtaggagatggcaatgagagactcacgtgcttcttcttgagagatatcgttactcggttgttccatcaaacaatcaatgccttcacacgctttctctttgtttcgtact

SEQ ID NO: 4623 - DNA, 1246 bp, Brassica napus
acggacgcctgcggtacggtccggaattttgggtcgagcacgcgtccgaaataaaatccactaagacctctctttaccattttcccactttcttttgagcaataaaacagaacgaaaacaagaaagaaaccagaaccaaaatggcactgagaatgtgggcttcctctacagcaaacgctctcaagctctcttcttctgcctccaaatctcatctccttccagctttctccatctctagatgcttctcctcagtgttggaaggacttaaatatgcaaattcacatgagtgggtgaaacatgaaggctcagtggctactattggcatcagtgaccatgcccaggatcatttaggagaagttgtgtttgtggagctgcctgaagaaaaaagttcagtgaccaaagagaaaaactttggagccgtggaaagtgttaaggcaacaagtgagattatatctccaatctctggtgaagtaatcgaggttaacacaaagctcgctgattcacctggcttgatcaactcaagcccttacgaagatggatggatgatgaaggtgaaaccaagcaaccctgcagagctggaatccttgatgggtccaaaggaatacaccaagttctgcgaagaggaagacgctgctcactagggtttcttcgtctttcccagtatgtcctaaacaaaaagcaaaacaagagaatccatgctaaaagtttcaatcttttcactacttctcaatgtttactacctctgtatcaaatttgtatctctgtaatactgttttggttaaaaatcattcgatgagtctcaagagagctttaactaagaataacacagagaacaaaaactttcgtcaattttcaatcatatatagttgaagagggtctaactttcaaacaaaaccaaagtcgtctgcatgagaaaggaaaagactttgatctgtacaattactcctatcagacagctacagctggtgagggtgagggtgaaggtgactcgtcgtaggagatggaaatcagctcagacctgagcttttccgcatcttcagagtttcttttagtgacgagtccgtttgttggtttcatatcagaggtcgttatagactcttgctcctcttcaggtgaagtgtaggagatggcaatgagagactcacgtgcttcttcttgagagatatcgttactcggttgttccatcaaacaatcaatgccttcacacgctttctctttgtttcgtactacggcaattctaaacgcc

SEQ ID NO: 4624 - DNA, 1187 bp, Brassica napus
tccactaagagctctctttaccatcttcccacttccctttgagaaagaaaacagaacaaagaaaaagaaagaaagcaaacagaaacaaatggcactgagaatgtgggcttcctctacagcaaacgctctcaagctctcttcttctgcatccagatctcatctccttccagctttctccatctccagatgcttctcctcagtgttggaaggacttaagtatgcaaattcacatgagtgggtgaaacatgaaggctcagtggctactattggcatcagtgaccatgcccaggatcatttaggagaagttgtgtttgtggagctgcctgaagaaaaaagttcagtgaccaaagaaaaaaactttggagcagtggagagtgtgaaggcaacaagtgagattatatctccaatctctggtgaagtcatcgaggttaacacaaagctcgctgattcacctggcttgattaactcaagcccttacgaagatggttggatgataaaggtgaaaccaagcaaccccgcagagctggaatccttgatgggtccaaaggaatacaccaagttctgcgaagaggaagatgctgctcactagggtttcttcgtctttcccagtatgtcctaaacaaaaagcaaaacaagagagaacccatgctaaatgtttcaatcttttcactacttctcaatgtttcctacctctgtatcaaatttgtatctctgtaatactgttttggttaaaaatcattcgatgagtctcaagagagctttaactaagaataacacagagaagaaaaactttcgtcaattttcaatcatatatagttgaagagggtctaactttcaaacaaaaccaaagtcgtctgcatgagaaaggaaaagactttgatctgtacagttactcctatcagacagctgcagctggtgacggtgaaggtgactcatcgtaggagatagaaatcagctctgatctgagcttttccgcatcttcagagtttcttttagtgacgactccgtttgttgtagttgtgacgacaggtttcacatctgaggacgtaatagactcttgctcctcttcaggtgaagtgtaggagatggcaatgagagactcacgtgcttcttcttgagagatatcgttactcggttgttccatcaaacagtcaatgccttcacacgctttctctttgtttcgtact

SEQ ID NO: 4625 - DNA, 740 bp, Brassica napus
gggtcgacccacgcgtccgctttgagaaagaaaacagaacaaagaaaaagaaagaaagcaaacagaaacaaatggcactgagaatgtgggcttcctctacagcaaacgctctcaagctctcttcttctgcatccagatctcatctccttccagctttctccatctccagatgcttctcctcagtgttggaaggacttaagtatgcaaattcacatgagtgggtgaaacatgaaggctcagtggctactattggcatcagtgaccatgcccaggatcatttaggagaagttgtgtttgtggagctgcctgaagaaaaaagttcagtgaccaaagaaaaaaactttggagcagtggagagtgtgaaggcaacaagtgagattatatctccaatctctggtgaagtcatcgaggttaacacaaagctcgctgattcacctggcttgattaactcaagcccttacgaagatggttggatgataaaggtgaaaccaagcaaccccgcagagctggaatccttgatgggtccaaaggaatacaccaagttctgcgaagaggaagatgctgctcactagggtttcttcgtctttcccagtatgtcctaaacaaaaagcaaaacaagagagaacccatgctaaatgtttcaatcttttcactacttctcaatgtttcctacctctgtatcaaatttgtatctctgtaatactgttttggttaaaaatcattcgatgagtctcaagaga

SEQ ID NO: 4626 - DNA, 819 bp, Raphanus sativus
ggatttaaagatagaaagcacaaaagccattaagagctctctttctttaccattttctcacattactttgagaaaacaagaaagacatggcactgagaatgtgggcttcttccacagcaaacgctctcaagctctcctcttctgcatccaaatctcatctccttccagctttctccatctccagatgcttctcctcagtgttggaaggactcaagtatgcaaactcacatgagtgggtcaaacatgaaggctcagtggctactattggcatcagtgaccatgcccaggaccatttaggagaagttgtgtttgtggagctgccagaagagaaaagttcagtgagcaaagaaaaaaactttggagcagtggagagtgtaaaggccacaagtgagattatatctccaatctctggtgaagtcattgaggttaacacaaagcttgccgattcacctggtttgatcaactcaagcccttatgaagaaggttggatgataaaggtgaaaccaagcaacccggcagagttggaatccttgatgggtccaaaggaatacaccaagttctgcgaagatgaagacgctgctcactagaggaattcagagcaacacaagaaagatcatgcctaaagtttccgtctgtttcacttgtcaatgtttctttacatctatctcagcttgtatcaggggtgatactaatgatcaagagaaatttgatttattttcggtcatatatacatagttgaggagacacgttaacatatgacattagtggtctacttttagacggtagcaaagcaagaaataagaaagacttggtgctgta

SEQ ID NO: 4627 - DNA, 779 bp, Raphanus sativus
  misc_feature (751)..(751): n is a, c, g, or t
  misc_feature (764)..(764): n is a, c, g, or t
attttcccacttccctttgagaaagaaaacagaaccaagaaaaaaaagagagaaagaaaacagaaaaaatggcactgagaatgtgggcttcctcaacagcaaacgctctcaagctgtcatcttctgcatccaaatctcatctccttccagcgttctccatctccagatgcttctcctcagtattggaaggacttaagtatgcaaattcacatgagtgggtgaaacatgaaggctcagtggctactattggcatcagtgaccatgcccaggatcatttaggagaagttgtgtttgtggagctgcctgaagaaaaaagttcagtgaccaaagagaaaaactttggagcagtggagagtgttaaggcaacgagtgagattatatctccaatctctggtgaagtcatcgaggttaacacaaagctcgctgattcacctggcttgattaactcgagcccttacgaagatggttggatgataaaggtgaaaccaagcaaccccgcagagttggaatccttgatgggtccaacggaatacaccaagttctgcgaagaggaagacgctgctcactagggtttctttgtctttgccagtatgtcctaagcaaaacaagagaacccatgctacagtttcaatcttttcgctacttgtcaatgtttcctatctttttttatcagatttgtatttctatactgttttggttaaagatcattcgatgagtctcaagagagctttaactaaaagtaacacacagngagaaactttcgncaattttcaatcata

SEQ ID NO: 4628 - DNA, 800 bp, Raphanus sativus
tctttaccattttcccacttccctttgagaaagaaaacagaaccaagaaaaaaaagagagaaagaaaacagaaaaatatggcactgagaatgtgggcttcctcaacagcaaacgctctcaagctctcttcttctgcatccaaatctcatctccttccagctttctccatctccagatgcttctcctcagtattggaaggacttaagtatgcaaattcacatgagtgggtgaaacatgaaggctcagtggctactattggcatcagtgaccatgcccaggatcatttaggagaagttgtgtttgtggagctgcctgaagaaaaaagttcagtgaccaaagagaaaaactttggagcagtggagagtgttaaggcaacgagtgagattatatctccaatctctggtgaagtcatcgaggttaacacaaagctcgctgattcacctggcttgattaactcgagcccttatgaagatggttggatgataaaggtgaaaccaagcaaccccgcagagttggaatccttgatgggtccaacggaatacaccaagttctgcgaagaggaagacgctgctcactagggtttctttgtctttcccagtatgtcctaaacaagaaaaaagcaaaacaagagaacccatgctacagtttcaatcttttcgctacttgtcaatgtttccttatcttttttttatcagatttgtatttctatacttttggttaaagatcattcgataacttttaatctttttcactacttctcaatgtttcctacctctgtatcagaattgtatttgtatctc

SEQ ID NO: 4629 - DNA, 716 bp, Raphanus sativus
ggatttaaagatagaaagcacaaaagccattaagagctctctttctttaccattttctcacattactttgagaaaacaagaaagacatggcactgagaatgtgggcttcttccacagcaaacgctctcaagctctcctcttctgcatccaaatctcatctccttccagctttctccatttccagatgcttctcctcagtgttggaaggactcaagtatgcaaactcacatgagtgggtcaaacatgaaggctcagtggctactattggcatcagcgaccatgcccaggaccatttaggagaagttgtgtttgtggagctgccagaagagaaaagttcagtgagcaaagaaaaaaactttggagcggtggagagtgtaaaggccaccagtgagattatatctccaatctctggtgaagtcattgaggttaacacaaagcttgccgattcacctggtttgatcaactcaagcccttatgaagaaggttggatgataaaggtgaaaccaagcaacccggcagagttggaatccttgatgggtccaaaggaatacaccaagttctgcgaagatgaagacgctgctcactagagcaacacaagaaaaaatcatgcttaaagtttgcgtcgtttcacttgtcaatgtttctttacatctatctcagcttgtatcaggggtgatactaatgatcaagagaaatttgatttattttcggttata

SEQ ID NO: 4630 - DNA, 837 bp, Arabidopsis lyrata
gtttgggtcacacttttttcgacgacaacattaagatgaggcctttgttttctgccatacatctaaagatagaacacaaacgtcaataaaagcaaattaagatctctctttactattttcccactttcctttgacaaaacacacaaaaaaaaaaaagaaaccagaagaaaaaatggcattgagaatgtgggcttcttctacagcaaatgctctcaagctctcttcctctgcctccaaatctcatctcttgccagctttctctatctccagatgcttctcctcagtgttggaaggacttaagtatgcaaattcacatgagtgggtgaaacatgatggctcagttgctacaattggtatcactgaccatgcccaggaccatttaggagaagttgtgtttgtggagctaccagaagcaaacagttcagtgagcaaagaaaaaagctttggagctgttgagagtgttaaggccacaagtgagattctatctcccatctccggtgaagtcattgaggttaacacaaagcttaccgagtcacctggtttgatcaactcaagcccttacgaagaaggttggatgataaaggtgaaaccaagcagccccgcggagctggaagccttgatgggtccaaaggaatacaccaagttctgcgaagacgaagatgctgctcactagggtttcttcggctttcatctttcccgaatgttcaacaaaacaagagagtccatgcttaaagtttcaatctttcatttctcaatgtttcttaccactctcagcttgcatcagtgtgatactaatttgattgaaagatcatccaatgcgactcaacagagctttta

SEQ ID NO: 4631 - DNA, 758 bp, Raphanus sativus
  misc_feature (76)..(76): n is a, c, g, or t
ggactaagacctctctttaccattttcccacttccctttgagaaagaaaacagaaccaagaaaaaaaaaagagagnaagaaaacagaaaaatatggcactgagaatgtgggcttcctcaacagcaaacgctctcaagctctcttcttctgcatccaaatctcatctccttccagctttctccatatccagatgcttctcctcagtattggaaggacttaagtatgcaaattcacatgagtgggtgaaacatgaaggctcagtggctactattggcatcagtgaccatgcccaggatcatttaggagaagttgtgtttgtggagctgcctgaagaaaaaagttcagtgaccaaagagaaaaactttggagcagtggagagtgttaaggcaacaagtgagattatatctccaatctctggtgaagtcatcgaggttaacacaaagctcgctgattcacctggcttgatcaactcaagcccttatgaagatggttggatgataaaggtgaaaccaagcaaccccgcagagttggaatccttgatgggtccaacggaatacaccaagttctgcgaagatgaagacgctgctcactagggtttctttgtctttccaagtatgtcctaaacaagaaaaagcaaaacaagagaacccatgctacagtttcaatcttttcgctacttctcaatgtttcctatctttttttatcagatttgtatttctatactgttttggttaaagatcattcgatgagtctcaaga

SEQ ID NO: 4632 - DNA, 667 bp, Raphanus sativus
  misc_feature (337)..(337): n is a, c, g, or t
  misc_feature (376)..(376): n is a, c, g, or t
  misc_feature (397)..(397): n is a, c, g, or t
  misc_feature (444)..(444): n is a, c, g, or t
acattactttgagaaaacaagaaagacatggcactgagaatgtgggcttcttccacagcaaccgctctcaagctctcctcttctgcatccaaatctcatctccttccagctttctccatctccagatgcttctcctcagtgttggaaggactcaagtatgcaaactcacatgagtgggtcaaacatgaaggctcagtggctactattggcatcagcgaccatgcccaggaccatttaggagaagttgtgtttgtggagctgccagaagagaaaagttcagtgagcaaagaaaaaaactttggagcagtggagagtgtaaaggccacaagtgagattntatctccaatctctggtgaagtcattgaggttaacacanagcttgccgattcacctggtntgatcaactcaagcccttatgaagaaggttggatgataaaggtgaanccaagcaacccggcagagttggaatccttgatgggtccaaaggaatacaccaagttctgcgaagatgaagacgctgctcactagaggaattcagagcaacacaataaaaatcatgcttaaagtttccgtcgtttcacttgtcaatgtttctttacatctatctcagcttgtatcaggggtgatactaatgatcaagagaaatttgatttatttttcggccata

SEQ ID NO: 4633 - DNA, 726 bp, Brassica juncea
aaaatggcattgagaatgtgggcctcttctacagcaaatgctctcaagctttcttcttctgtctccaagtctcagctctctccttctttctccatctctagatgcttctcttcagtattggatggattgaagtatgcaaattcacacgagtgggttaaacatgaaggctctgttgccaccattggcattactgaccatgctcaggaccatttaggtgaagtggtgtttgtggaactgccagaggaaaatggttcggtgagcaaagagaaaagctttggagcagtggagagtgtgaaggcgacaagtgaaatcttatcaccgatctcaggtgaagtcattgaggttaacaagaagctcacagaagcaccaggcttgattaactcaagcccctatgaagatggatggatgatcaaagtgaagccgagcaacccatctgagttggaatctttaatgggttcaaaggaatacatcaagttctgtgaggaggaagacgctgctcactaggagagtttttctctacttctatgttccaaatatccttcaaaaaaagaatttttttatatcagttctcatgcatattttcataaccaacacaccgatgaatgtatggttcgttggcttttttctatcacaaacatttgtttatacaccagataagtctatgattcttccttgttagcatatagaaaaagactttgaaagcttcaaataacaaacgttgtcaca

SEQ ID NO: 4634 - DNA, 710 bp, Brassica napus
caaaaacaaaaaatggcactgagaatgtgggcttcttctacagcaaacgctctcaagctttcttcttctgtctccaagtctcagctctctcctgctttctccatctctagatgcttctcttcagtgctggagggattgaagtatgcaaattcacatgagtgggttaaacatgaaggctctgttgccactattggtattactgaccatgctcaggaccatttaggagaagtggtgtttgtggaactgccagaggaaaatggttcggtgagaaaagagaaaagctttggagctgtggagagtgtgaaggcgacaagtgagattttatctcccatctcaggtgaagtcattgaggttaacaagacgctctcagaagcaccaggcttgatcaactcaagcccctatgaagatggatggatgatcaaagtgaagccgagcaacccctcagagttagaatctttgatgggttcaaaggaatacaccaagttctgtgaggaggaagacgctgctcattaggagggtttatctctacttttatgttccaaatttccttataaaaaaatctttaaaagtatatcagttctcatgcatatcttcataaccaacacaccaaaatgtatgggttcgtgggtttaatatcacaaacatattttatacactatataggctatgattctttttgttaacatatataggaagacttttgtcaacca

SEQ ID NO: 4635 - DNA, 747 bp, Brassica napus
  misc_feature (546)..(546): n is a, c, g, or t
  misc_feature (549)..(549): n is a, c, g, or t
  misc_feature (567)..(567): n is a, c, g, or t
  misc_feature (589)..(589): n is a, c, g, or t
  misc_feature (602)..(602): n is a, c, g, or t
  misc_feature (721)..(721): n is a, c, g, or t
gaaatctcctatttgtttggagaagacaaaacacatagcaagaaagaagcaaagaaacaaaaacaaaaaatggcactgagaatgtgggcttcttctacagcaaacgctctcaagctttcttcttctgtctccaagtctcagctctctcctgctttctccatctctagatgcttctcttcagtgctggagggattgaagtatgcaaattcacatgagtgggttaaacatgaaggctctgttgccactattggtattactgaccatgctcaggaccatttaggagaagtggtgtttgtggaactgccagaggaaaatggttcggtgagaaaagagaaaagctttggagctgtggagagtgtgaaggcgacaagtgagattttatctcccatctcaggtgaagtcattgaggttaacaagacgctctcagaagcaccaggcttgatcaactcaagcccctatgaagatggatggatgatcaaagtgaagccgagcaacccctcagagttagaatctttgatgggttcaaaggaatacaccaagttctgngangaggaagacgctgctcantaggagggtttatctctacttntatgttccaaatntccttataaaaaaatctttaaaagtatatcagttctcatgcatatcttcataaccaacacaccaaaatgtatgggttcgtgggtttaatatcacaaacatattttatacactatatagnctatgattctttttgttaacatatat

SEQ ID NO: 4636 - DNA, 695 bp, Brassica juncea
cctctacagcaaacgctctcaagctctcttcttctgcctccaaatctcatctccttccagctttctccgtgtccagatgcttctcctcagtgttggaaggacttaagtatgcaaattcacatgagtgggtaaaacatgaaggctcagtggctactattggcatcagtgaccatgcccaggatcatttaggagaagttgtgtttgtggagctgcctgaagaaaaaagtgcagtgaccaaagagaaaaactttggagctgtagagagtgttaaagcaacaagtgagattatatctccaatctctggtgaagtcatcgaggttaacacaaagctcgctgattcacctggcttgatcaactcaagcccttacgaagatgggtggatgataaaggtgaaaccaagcaaccctgcagagctggaatccttgatgggttcaaaggaatacaccaagttctgcgaagaggaagacgctgctcactagagggtttcttcgtctttcccagtatgtcctaaacaaaaagcaagacaagagaatccatgctaaagtttcaatcttttcactacttctcaatgtttcctacctctgtatcagatttatatcccagtaatactattttggttaatctcaatagagctttaacaatagagataaataccattcatacttaaaaagttataagtcttgcaacatagagat

SEQ ID NO: 4637 - DNA, 796 bp, Arabidopsis lyrata
aatttctgccttacatatcaaaagatagaacacacacacaaataaagcaaacaaagagaatatctttgagatctcctctttatttggagaagacaaaacacagaacaacaaggaagagaaagcaaaaatggcactaagaatgtgggcttcttctacagcaaacgctctcaagctttcttcttctgtttccaagtctcatctctctcctttctccatctctagatgcttctccacagtgttggagggattgaagtatgcaaattcacacgagtgggttaaacatgaaggctctgttgccaccattggcatcactgcccatgctcaggaccatttaggtgaagtggtgtttgtggaactgccagaggaaaatacttcagcgaccaaagagaaaagctttggagcagtggagagtgtgaaggccacaagtgagatcttatcaccgatctcaggtgaaatcattgaggttaacaagaagctcacagaatcacctggcttgattaactcaagcccctatgaagatggctggatgatcaaagtgaaaccgagtagccccgcggagttggaatctttgatgggtccaaaggagtacaccaagttctgcgaggaggaagacgccgctcactaagagggtttctctctgtcctttatgttccaaaatctatcaattctcatgcttatttcctaaatttgcatacactctgtgaccaacatcacaaaataagagttcaagaagatgaaacagagatctaacaaacaaattgagattttttccatcatataacttcttgttatcctc

SEQ ID NO: 4638 - DNA, 661 bp, Brassica juncea
cctctacagcaaacgctctcaagctctcttcttctgcatccagatctcatctcctgccagctttctccatctccagatgcttctcctcagtgttggaaggacttaagtatgcaaattcacatgagtgggtgaaacatgaaggctcagtggctactattggcatcagtgaccatgcccaggatcatttaggagaagttgtgtttgtggagctgcctgaagaaaaaagttcagtgaccaaagaaaaaaactttggagcagtggagagtgtgaaggcaacaagtgagattatatctccaatctctggtgaagtcattgaggttaacacaaagctcgctgattcacctggcttgattaactcaagcccttacgaagatggttggatgataaaggtgaaaccaagcaaccccacagagctggaatccttgatgggtccaaaggaatacaccaagttctgcgaagaggaagacgctgctcactagggtttcttcgtctttcccagtatgtcctaaacaaaaagcaaaacaagagaggacccatgctaaatgtttcaatcttttcactacttctcaatgtttcctacctctgtatcaaatttgtatctctgtaatactgttttggttaaaaatcattcgatgggtctcaaaaaaaaaaaaaaaaaaaa

SEQ ID NO: 4639 - DNA, 803 bp, Arabidopsis thaliana
aatttctgccttacatatcaaaagatagaacacacacacaaataaagcaaagaaacagaatatctttgagatctcctctttatttggagaagacaaaacacagaacaagaattagaaagaagggagagaaagcaaaaatggcactaagaatgtgggcttcttctacagcaaacgctctcaagctttcttcttctgtttccaagtctcatctctctcctttctccttctctagatgcttctccacagttttggagggtttgaagtatgcaaattcacatgagtgggttaaacatgaaggctctgttgccaccattggcatcactgcccatgctcaggaccatttaggtgaagtggtgtttgttgaactgccagaggacaatacttcagtgagcaaagagaaaagctttggagcagtggagagtgtgaaggcaacaagtgagatcttatcaccaatctcaggtgaaatcattgaggttaacaagaagctcacagaatcacctggcttgatcaactcaagcccctatgaagatggttggatgatcaaagtgaaaccaagtagccccgcggagttggaatctttgatgggtccaaaggaatacaccaagttctgcgaggaggaagatgctgctcactaggagggtttctctctgtcttttatgttccaagttctatcaattctcatgcttgttttctaaatttgcatacactctatgaccaacttcacaaaataagagttcaagaagatgaaacagagacctaacaaacacattaagattttttctttcatatatcttgttatcctc

SEQ ID NO: 4640 - DNA, 792 bp, Thellungiella halophila
gagataatctcctctttactgaggaagacaaaccacagagcaagaaagaagtgagaaagaagaaaatatggcactgagaatgtgggcttcttctacagcaaacattctcaagctttcttcttctgtatccaagtcccatctctctcctgctttctctatctgtagatgcttatcctcagtgttggagggattgaagtatgcaaattcacacgagtgggttaaacatgaaggctctgttgccaccattggcattactgaccatgctcagggccatttaggtgaagtggtgtttgtggaactgccagaggaaaatggttcagtgagcaaagagaaaagctttggagcagtggagagtgtgaaggcgacaagtgagatcttatcaccgatctctggtgaagtcattgaggttaacaagaagctcacagaatcaccaggcttgatcaactcaagcccttatgaagatggttggatgatcaaagtgaggccaagcagcccagcagagttggaatctttgatgggtccaaaggaatacaccaagttctgcgtggaggaagacgccgctcactaggagggtttctctgtctctatgttaccaaaatgccttgaaaagttcataaaatgtgaataaaccagtccaaatctaccaattctcatgcttatttcctctattcgcatacactgtgaccagcatcacaacataagaattcaagaagatgatggagagatctaacaaacacaccgatgaatgtatgtaatgtttcattgatttttcaatcacaaacatattcttat

SEQ ID NO: 4641 - DNA, 998 bp, Brassica napus
gagagtgttgctgcggtccggccggttgtgcgagtcgaccagcgcgtccgcggacgcgtgggagacatggcactgagaatgtgggcttcttccacagcaaacgctctcaagctctcctgggttgctttcgaaacccataaagtggccgctttctaaccatccagatgcttctgcttagtgttggaaggactcatgtatgcaaattcacatgagtgggtcaaacatgaaggctcagtggctaccattggcatcagtgaccatgcccaggaccatttaggagaagttgtgtttgtggagctgccataagagaaaagttcagtgagcaaagaaaaaaactttggagcagtggagagtgtaaaggccacaagtgagattatatctccaatctctggtgaagtcattgaggttaacacaaagctcgccgattcacctggtttgattaactcaagcccctatgaagaaggttggatgattaaggtgaaaccaagcaacccagcagagttggaatccttgatgggtccaaaggaatacacaaagttctgcgaagaagaagacgcggcgtcactttaggattcccgaagccaaacacggagaaaatcatgccttaaaggttttcaggttatttttttcactttggtcaaaggggttctttttacattcttcttttcaagccttggttgttcaagtggggggagatataacccccactttttgatttaaggaaacaatggctttttgaagaacttaaccctggggccttttattataaattttttaaataaagagaggggggttattaaagccccccaaaaaaaaaaaaaaaaaaaaaaaggggccgggcgcttcttttagggagtccaggcttacgtttcccggggcgtgggacagtatataatttttttttaggggggccttaaatcaaattaccggggcggggtgtttaaccctgggggcgggggaaaactgggggtcccccattatttggttgtggggcaccc

SEQ ID NO: 4642 - DNA, 643 bp, Cleome spinosa
attcacaaaggaaaaaaagaagagagatggctctgagaatgtgggcttcttctacagccaacgctctcaagctctctcgcgcctccaaggctaacctctctcccgctttctccatctccagatgcttctccacagtgttggaggggctgaagtatgcgagttcacacgagtgggtgaaacatgaaggctctgtggctatcattggcatcagtgaccatgcccaggaccatctaggtgaagtggtgtttgtggagctgccagaagagaatgcttcagttaacaaagacaaagcctttggagctgtggagagtgtcaaagccacgagtgaaatcatttcccccatctccggtgaagtcattgaaatcaacacaaaactcgccgactcgcccggcctgatcaactcgagcccttatgaagatggctggatgatcaaagtgaagccaagcagtccctcggagctggaatctttgatgggtccaaaggaatacaccaagttctgcgaggaagaagatgcttctcactagccctaaaaagaagaaaaacaatgaaaatccacaaactgacccaccataaagatcaatctatcaattctcgtgtttctttctcctcagcttgtgtggattactctccattttccttttac

SEQ ID NO: 4643 - DNA, 816 bp, Cleome spinosa
aaatccataaccaaaatacccctcattcaatcaaccaaaaacacaccacacagaaaaaataggcgctgaggatgtgggcttcttctacagctaacgctctcaagctctcttgtgcatccaaatccagcctctctcctgctttctccatctccaggtgcttctccacagtgttggagggactgaagtatgcaaattcacacgagtgggtgaaacatgaaggctctgtggctaccattggcatcactgaccatgcccaggaccatctaggtgaagtggtgtttgtggagctgccagatgaaaagagttcagtgaacaaagacaaaccctttggagcagtggagagtgttaaagccacaagcgaaatcatttccccaatctccggtgaagtcattgaaatcaacacaaaactcggcgattcacctggcttgatcaactcaagcccctatgaagatggttggatgatcaaagtgaagccaagcagtccctcggagttggagtccttgatgggtccaaaggaatacaccaagttctgcgaggaagaagatgcttctcactaggatttctccggtcttttaccttccgagtgccctaaaaagaagacaaatatgaaaacgagaaaaaaaacaacgcactggttgattacaagttcaatctatcgattctcatgtttctttcctttcagctggtatatgccttcgatttgtcttacaacattcatgcctgtgacaatatgtatgaatccgcgaaagagcaaacgatacagactatctaacaagatcacaaaggcaggcttaatttgattttgtcatcattcca

SEQ ID NO: 4644 - DNA, 761 bp, Raphanus sativus
  misc_feature (691)..(691): n is a, c, g, or t
acagagcaagagaagcaaagaaacaaaacaaaaatgtgggcttcgtctacagcaaatgctctcaagctttcttcttctgtctccaagtctcagctctctccatctttctccatctctagatgcttctcctcagtgttggagggattgaagtatgcgaattcacatgagtgggttaaacatgaaggctctgttgccatcattggcatcactgaccatgctcaggaccatttaggtgaagtagtgtttgtggaactaccagaggaaaatggttcagtgagcaaagagaaaagctttggagcagtggagagtgtgaaggcgacaagtgagatcttatctcctatctcaggtgaagtcactgaggttaacaagaagctaatagaagcaccaggcttgattaactcaagcccctatgaagatggatggatgatcaaagtgaaaccaagcaacccatctgagttagaatctttaatgggttcaaaggaatacaccaagttctgcgaggaagaagatgccgctcactaggagggtttctgtctacttgtatgttccaaatgtcctataaagtataaaagtatatcagttctcatgcatattctcataagtcataaaccgacacaccaatgaatatgtatagttcgttggtttttaatatcacaaacatattttaatacaccagatgagtctatgattnttctttgttaacatataaagaagaccttgaaagcttcaaataacaacatttgtcacgccaaaaaaaaaaa

SEQ ID NO: 4645 - DNA, 1074 bp, Quercus alba
aggttaggatgaggctttcgttgcccaccattcatccaagataacaaaaccaggaaatatatgaacttaactccttcattctttgttatctacctctgcgcttgagataaccacaaacacagataatatagaagataacatggctctgagaatgtgggcttcttccacagccaatgcactcagaatttcttgtgcctccaaagcccatctctctcctgcattttcgctctcccgctgcttctcttctgttttggatgggttgaagtatgcttcttcacatgagtgggtgaagcatgaaggcccggtggctacaattggtatcaccgatcatgctcaggaccatcttggagaggtagtgtttgtggaactgccagagcctggtggctcggtttcacaaggtagcagctttggagccgtggaaagtgtcaaagcaaccagtgatatcaattctccaatctcgggtgaggttgttgaggttaattcaaagctgactgaatcacctggcttgattaataaaagtccatatgaagacggatggatgatcaagctgaagccaagcaatccatcagaattagaatccttgatgggttcaaaggaatacacaaaattctgtgaggaggaagatgctgcacattagaatttgttgccgcaaccatcttagattaactgatcctcagctgtttaagatcactgttattttttatcctttgtcaataatccctgctttccattggaccttttaggtatcatataattaaaaaaaaaaaaagttacttgtcatcgattttgaagttgctggctccaagtcagtgtaatatgcctactattccctctccctcccacttttgtaattcggtatcttcctgtggattccttcctattttaatttatttcatttgcgtttgttgaaattttctcatcagcgacgagttgtatgatgtatctaaatatctaataagtgtaacttctcattcacaatatgcaagtcttataggttatcaaaaaatatgtaagtctaataagtgggacccacacattatgggtgagatgttacatatataaaaaacatggtac

SEQ ID NO: 4646 - DNA, 801 bp, Quercus alba
cgcggggatctacctctgcgcttgagataaccacaaacacagataatatagaagataacatggctctgagaatgtgggcttcttccactgccaatgcactcagaatttcttgtgcctccaaagcccatctctctcctgcattttcgctctcccgctgcttctcttctgttttggatgggttgaagtatgcttcttcacatgagtgggtgaagcatgaaggcccggtggctacaattggtatcaccgatcatgctcaggaccatcttggagaggtagtgtttgtggaactgccagagcctggtggctcagtttcacaaggtagcagctttggagccgtggaaagtgtcaaagcaaccagtgatatcaattctccaatctcgggtgaggttgttgaggttaattcaaagctgactgaatcacctggcttgattaataaaagtccatatgaagacggatggatgatcaagctgaagccaagcaatccatcagaattagaatccttgatgggttcaaaggaatacacaaaattctgtgaggaggaagatgctgcacattagaatttgttgccgcaaccatcttagattaactgatcctcagctgtttaagatcactgttattttttatcctttgtcaataatccctgctttccattggaccttttaggtatcatatattaaaaaaaaggctattgtcatcgattttgaagttgctggcttcaagtcagtctaatatgcctactattccctctccctcccacttttgtaattcggtatcttcctgtggattccttcctatttttaa

SEQ ID NO: 4647 - DNA, 517 bp, Prunus persica
agagataacgcaggcagagaaacatggcactgagaatgtgggcttcttctactgccaatgcactcagaatctctagtgcctccaaagcccacctctcccctgcattttctttttccagatgcttttcttctgttctggaagggttgaagtatgcatcttcacatgagtgggtgaagcatgaaggctcagttgcaacaattggtatcactgatcatgctcaggaccatcttggagaagttgtgtttgttgagctgccagaagctggtcgctcagtctctgcaggtgtcggctttggagctgtggagagtgtcaaagcaaccagtgatataaattccccaatttctggtgatgttgttgaggttaactcaaagcttactgaatcacctggtttgatcaattcaagcccatatgaagatggatggatgatcaagattaagcccagcaatccatcagaattagaatccttgttgggtgctaaagaatacacgaagttttgcgaggaagaagatgccgccca

SEQ ID NO: 4648 - DNA, 741 bp, Antirrhinum majus
  misc_feature (690)..(690): n is a, c, g, or t
aaagaaaaaaaggaaagagagcagataatagagagaaacaacaatggcactgagaatgtgggcttcttcaacagccaatgctctaaagctctccacaaatgcttccaaatcatctctcctcgcccctgccttctcactctccagatgcttttcaactgtgctggagggggccaagtatgctacatcccatgaatgggtgaagcacgagggcgctgtggctaccgttggaattacggaccacgctcaggatcatttgggagaagtggtgtttgtggagctaccagaggcagggaaatccgtgacaaaaggcgagagcttcggtgcagtggagagtgtgaaggccaccagtgatgtgaactctcccatatccggcgaggttgttgaggtcaacacaaagctaagtgaaactccaggactgatcaactcggggccatatgaagatggatggatgattaaagtgaagcctagcgatccttcagagttggagtccttaatgggttccaaagagtacacaaaattctgtgaagaagaagatgctgctcattgatgtgattctgcttctgtaaattaacttgttgttttactacttacaattttcaacttcgcctctactctcttcacttaatctactcatctattcttcagtttttcaataaaaaagatatattcacatgtgggacatatcagatntattatcgacatcgacactagctagtgtcttattagtgaccaaaaaaaaaa

SEQ ID NO: 4649 - DNA, 964 bp, Vitis vinifera
gaagggaatatagagcatagaagtagagggtctttgaatatttggtcttaggatgaggctttcagtggccaccattcatcaaagataaaacagaagacacataaagagagaggagccaccacctcctctccttagtggtttgaggctttgagccaaccaaagacacaggaagagagaaggcaaaataaagaagataacatggcactgagaatgtgggcttcttctactgctaatgctctgagagtctcttgtgcctccaaagctcacgtgtctcctgcattttctctctcaagatgcttttcctctgttttggatgggttgaagtatgcaacttcacatgaatgggtgaagcatgaaggctcagtggcaacaattggtatcactgatcatgctcaggaccacctaggagaagtagtgtttgtggagctaccagagcctggtggttcagtttcaaaaggaaacggctttggagctgtggaaagtgtgaaagcaaccagtgatgtcaattccccaatctctggcgaggttgttgaggtcaactctaagcttagtgaagcgcctggtttgatcaattcaagcccatatgaagatggatggatgatcaaggtgaagcctggtaatccatcagagttggaatccttgatgggtccaaaggaatatacgaaattctgtgaggaagaagatgctgcccattagaattttccatatgttttttgtgtatgcttttcttgaaccgacttaccttgagctgttaaaggtcaatatcttcagaactgcaggctccaactatgtgaagactgctatcttttctttctttattgttcttcaacctttttgtatttctgcatcttcatgtaatttagaaccattcctcctttctatctcacctcatctactgttcttcattcaactgatttctaaattcttcaggaatttatggcaagttctagtaggtttaggtgcc

SEQ ID NO: 4650 - DNA, 844 bp, Pisum sativum
caggaaaacacacactcacatacatgaacaatatctcatcatttcatttcattcttctacacactcctcacaaacacaacccttaacaataacaatggcacttaggatgtgggcttcttcaactgccaatgcactcaaactctcctcttcctctagattacatctctcccctaccttttccatctccagatgtttctctaatgttttggatggactcaagtacgcaccttcacatgaatgggtcaagcatgaaggatcagtagccactattggtatcactgaccatgcccaggaccatcttggagaggttgtgtttgtggagcttccagaacctggtgtctcagttacaaagggtaaaggtttcggagctgttgaaagtgtgaaggcaacaagtgatgtaaactctcctatttccggtgaggttatcgaggttaatactgggctcaccggaaagcctggcctcatcaattcaagcccctatgaagatggatggatgataaaaataaagccaactagtccagatgaattagaatccttgttgggtgcaaaagagtacacaaagttttgtgaggaagaagatgctgcacattgatgttcatttttcaatatattgaactgactgtttttaatattgtactactatctatcatcttgttgtctattttttttcaaatgcaatagaattgcttcaagttattgttgtttccatgcgacacttcagtgtgtcagtctatctagcttgtcatgtactaattaagaagcaaatttgttttttctcatccagttattattttcacttcaatgttttcacaatgatttttgataacaaagttcagatcggtca

SEQ ID NO: 4651 - DNA, 680 bp, Raphanus sativus
ggaaaacacagagcaacagaagcaagagaagcaaagaaacaaaaacaaaaatgtgggcttcgtctacagcaaatgctctcaagctttcttcttctgtctccaagtctcagctatctccatatttctccatctctagatgcttctcctcagtgttggagggattaaagtatgcgaattcacatgagtgggttaaacatgaaggctctgttgccaccattggcatcactgaccatgctcaggaccatttaggtgaagtggtgtttgtggaactaccagaggaaaatggttcagtgagcaaagagaaaagctttggagcagtggagagtgtgaaggcgacgagtgagatcttatctcctatctcaggtgaagtcattgaggttaacaagaagctaacagaagcaccaggcttgattaactcaagcccctatgaagatggatggatgataaaagtgaagccaagcaacccatctgagttagaatctttaatgggttcaaaggaatacaccaagttctgcgaggaagaagatgccgctcactaggagggtttctctctacttgtatgttccaaatgtccttattaaaagaaaactaataaaagtatatcagttcgcatgcatattctcataagccataaccaacacaccaatgaatgtatggttcgttggtttctaatatcacaa

SEQ ID NO: 4652 - DNA, 720 bp, Triphysaria pusilla
acaacactgaaacaagaaaaacccatttataagctgaacaataaaagaaagcagataagaaaaaaaaagaataatttcaaacaatggcactcagactgtgggcttcttctacagccaatgctttgaagctctcagcttctgcttcacctgctttcactctctccagaagcttttcaactgttttggagggtttgaaatatgctacttcgcatgaatgggtaaagcatgatggcgctgtggctacaattggaatcacagaccatgcccaggatcatctaggagaagtggtgtttgtggagttgccagatgcaggcaaaccagtgtcacaagcaaacagttttggagcagtcgaaagtgttaaggcgactagcgatatcaactctcccatctccggtgaggtcgtcgaggtcaacaccaagctatccgactctcccggattgatcaactcaagcccatatgaagatgggtggatgataaaagtgaagcctagtaatccttcagaactggaatccttaatgggagctaaagagtatactaagttctgtgaagaagaagatgcttcacactaatgaatccttaatatactgcttttttttgttcaaacttgaatgttcattatttatgcagtatattaatttaatcattctcttgtcagaataactattgttcaaattagcaaatgcaagttcaagtttcaggttcgaaaaaaaaaaaaaaaag

SEQ ID NO: 4653 - DNA, 722 bp, Mimulus guttatus
aaattaagcagataatatacaacagcaacaatggcactgagaatgtgggcttcttctacagccaatgctctgaggctctcttcttcttcttcctctagattcgctcctgcattctctctctctagaaccttctctactgtgctggaggggttcaaatatgccacctcacatgaatgggtgaagcacgacggctccatcgccaccattggcatcactgaccatgctcaggaccatttgggagaagtggtgtttgtggagttgccggagggaggcaaagcggtggcgcaggcgagcagtttcggcgcggtggagagtgtgaaagccaccagtgatatcaactctccgatctccggcgaggtcgtcgaggtcaacaccaagctaaccgagtctcctggtttgataaattcaagcccatatgaagatggatggatgatcaaagtgaagccaagcaatccttcagaattggaatctttaatgggaccaaaggagtacactaaattctgtgaagacgaagatgcttctcactaatcatgtcttaattatcttaattatgtgttttttctttttttttttaatccaaacttatgttccatttttttatgtattagtaatgttaagttctggttaattgatttttaaccacttgcatctcttaatttcgatattaattatgttgatatcatcacccttattataaaagtgaaaaactggtgaaattatca

SEQ ID NO: 4654 - DNA, 845 bp, Cucumis sativus
tttcttttattctttgctgttaccaaaacagagaaggaagaacaacaaaacacagcaaattaaacacactcacaaaaaaatagctatggctcttagaatgtgggcttcttctactgctaatgcactcaaactctcttcttcatctaaaacccatctctctccttcattctctctctccagatgcttctccactgttttggatgggctgaagtatgcttcttcacatgagtgggtgaagcatgaaggctctgttgctaccgttggcatcactgaccatgctcaggatcatctgggagaagtggtgttcgtggatctgccagaatcaggtagttcagtttctcaaggtaagagctttggagcagtggagagtgtgaaagcaactagtgatatcaactctccaatctctggtgagattgttgaagttaacccacagcttaaggaatctcctggtttgatcaattcaagtccatatgaagggggatggatgataaaagtgaagccaagcaatccaggtgaattagattctttgctcggtccaaaggaatatacaaagttttgtgaggaagaagatgcagcccactaaagctgaacaaacgaatgtttcatctccaaacagagcttaagctaattcctttccaaagctggttgaattgttgacatatcacaagctatttctatgaagaaagagagccaaaaaataattacaagttcattgtgagttgaaatgtgcctaagcatctgaactacattctttcttcaatgtttattccacttgaaattaattgaatttctttgccttatttttagccattagttcttcagtatgctgaatttgattgaattca

SEQ ID NO: 4655 - DNA, 743 bp, Malus domestica
tgtccttccctcctttcttcgatattagcctctggtggtttgagataaccagacacacacagagagagatagaattaagcagagagagagagaagaaatatggcactgagaatgtgggcttcttctacagccaatgcactcagaatctccactgcctccaaatcccacctctctcctgcattttctctctccagatgcttttctactgttttggatggattgaagtatgcatcttcacatgagtgggtgaagcatgaaggctctgtggcaacaattggcatcactgatcatgctcaggaccatcttggagaagtagtgtttgttgagctaccagaagctggtcgctcagtctctcaaggaggcagctttggagctgtggaaagtgtcaaagcaaccagtgatgtaaattctccaatctccggcgaagtcgtcgaggttaactcaaagcttactgaatcacctggtttgatcaattcgagcccatatgaagatggatggatgatcaagatcaagcccagtagtccatcagaactagaatccttgttgggacctaaagaatacacgaagttttgtgaggaagaaaatgcagcccattgaactaattgattttcagctgtttaaggtttaattaatgtttggttaagttgttaaacattattatcaaagtactgcagaatctacgtcaaacctcatgtttcaaccttctgcctacattttatgtgaataaaagtacttgttgaatc

SEQ ID NO: 4656 - DNA, 660 bp, Phaseolus coccineus
gataaaacataaccaaaacacagacacaagaacaacctcaatctctgtctctaatggcactcaggatgtgggcttcttccactgccaatgcactcaaactctcttctgcctccagaccccatctccttcctcctttttctttctccagatgcttatctactgtcttggatggacttaagtacgcagaatcacacgagtgggtcaagcatgaaggctcagtcgccaccattggtatcactgaccatgctcaggaccatcttggagaagttgtgtttgtggagctgccagaaccaggtggtgcagtgtccaagaattctggctttggagctgttgaaagtgtcaaagcaacaagtgatataaactctccaatctcaggggagattgttgaggttaacacaaagctcacagaaacgcctggcctggtaaactcaagcccttacgaagatgggtggatgatcaaagtaaagccaagtgatccttctgaattagagtccttgttgggtccaaaggaatacacaaaattttgtgaggaggaagatgctagccattgaagtttgaattggctcctgcacttatatttggaactattattcatgtgtttatcatcttattgtcttctgaacagttttttaatctgcaatagaactgtttctttctatt

SEQ ID NO: 4657 - DNA, 882 bp, Castanea mollissima
ctgtattcaggtcttaggttaggatgaggctttcgttgcccaccattcatccaagataacaaaaccaggaaatatatgaacttaattccttcattctttgttatctacctctgcgcttgagataaccagaaacacagataatatagaggataacatggctctgagaatgtgggcttcttccacagccaatgcactcagaatttcttgtgcctctaaagcccatctctctcctgcattctctctctcccgctgcttctcttctgttttggatggattgaagtatgcttcttcacatgagtgggtgaagcatgaaggcccggtggctacaattggtatcaccgatcatgctcaggaccatcttggagaggtagtatttgtggaactgccagaacctggtggctcagtttcacaaggtggcagctttggagccgtggaaagtgtcaaagcaaccagtgatgtcaattctccaatctcgggtgagattgttgaggttaattcaaagctggctgaatcacctggcttgattaataaaagtccatatgaagacggatggatgatcaagctgaagccaagcaatccatcagaattagaatccttgatgggttcaaaggaatacacaaaattctgtgaggaggaagatgctgcacattagaatttgttgccgcaacaatcttagactaactgattctcagctgtttaagatcactgttattttttatcctttgtcaataatccctgctttccattggaccttttaggtatcatatttatattaaaaaaagttgtcatcgatatgcctactattctctcttccacttttgtaactcggtatcttcctgtggattcctttctattttaatttatttcatttgtgtttgttag

SEQ ID NO: 4658 - DNA, 916 bp, Trifolium pratense
ctttaacacctctatctcattctgatcatttcactcttatttttatcattatcattattgtaccaacatcacaaacacaaacaaagaagcataagcacaacaatggcactgaggatgtgggcttcttcaactgccaatgctctcaaactctcttcttctgcttcaagattacatctctcccctcccttttccatctccagatgtttctctagtgtcttggatggactcaagtacacatcttcacatgaatgggttaagcatgaaggctcagtagccacaattggcatctctgaccatgctcaggaccatcttggagaggttgtgtttgttgagcttccagaacctggtggttcagttacaaagggtaacggtttcggagcagttgaaagtgttaaggcaacaagtgatgtaaactctccaatttctggtgagattgttgaggttaatgataagctcactggaaaacctggcctgattaactcaagcccatatgaagatggatggatgatcaaaataaagccaagtgatccatctgaattagaatcattgttgggtgcaaaggagtacacaaaattttgtgaagaagaagatgctgcacattgaacttaatttgaaaacattatgggactgactgttttttcatatatgtactatgatattgttatctactttcttcaagtgcaatagaattgcttcaagttattgtttttttcatgctattattattgtcaccgacactttaatgtgtcagtctatatatctagtcctataattaagaagcaaatttaagtttcttttttacttctatccattattattttcacttggatgcattatgtatgcattatgttacaagttagaacaacatgttcaaaagaatagaaatagaaatatgaaaatgcaaacaaagaaaaaa

SEQ ID NO: 4659 - DNA, 823 bp, Lotus japonicus
attcatccaagataaagtttgagaaaacatatatcaaaagcaccacctccaatatctcattgtttcagtgacaaaacagagaagagagacacacacacagaaacactagtctaatctaatggctctgaggatgtgggcttcttcaactgcaaatgcactcaaactttcttcctctgcctccaggcttcacctttctcctcctttttctctctcaagatgcttctcttctgtcttggatggactcaagtacgcttcttcacatgaatgggtcaagcatgaaggctctgtagctaccattggtatcactgatcatgcccaggaccatcttggagaggttgtgtttgtggagctgccagaatccggtaagccagttactaaaggtgacggttttggagcagttgagagtgttaaagctacaagtgatatcaactctccaatctcaggggagattattgaggttaacactaagctctccgaacaacctggcctgatcaacacaagcccatacgaagatggatggatgatcaaagtgaagccaagcagtccatctgaattagattccttgttgggtccacaggagtatacaaaattctgtgaggaagaagatgctgcacattgaagtttgaactcgttactgcagttatattggactgactgtttctcatatgtttatgttcttaattaattatcatgttttaaacagtttttttcaagtacaatacaactgctttccaatttttctttctctgcaatttattgttactgacacttcagtgtgtctacctcctcatctaatgcactattactttggcttggttgtcca

SEQ ID NO: 4660 - DNA, 888 bp, Medicago truncatula
atacatccaagataatattttgggaaaaggaaaacacacaaacacacatacattcaacacctctatctatctcatcatttcattgatatttttattattatttgtactcttatcacaaacacaacacaaagaagcagaagtagtcttaacaatggcactgaggatgtgggcttcttcaactgccaatgctctcaaactctcttcttcttcctccagattacatctctcccctcctttttccatctccagatgtttctcaactgtgttggatggactcaagtatgcatcttcacatgaatgggtgaagcatgaaggctcagtagccactattggtatcactgaccatgctcaggaccatcttggagaggttgtgtttgtggagcttccagaacctgggggttcagttacaaagggtaatggtttcggagctgttgaaagtgttaaggcaacaagtgatgtaaactctccaatatctggtgagattgttgaagttaatgataagctcactggaaaacctggcctgatcaactcaagcccatatgaagatggatggatgatcaaaataaagccaagtgatccatctgaattagaatccttgttgggtgcaaaggagtacacaaaattttgtgaggaagaagatgctgcacattgaaattaattttcaatatatgggactgactctttttttatatatgtactatgatattgttatctactttcttcaagtgcaatagaattgcttcaagttgttattgttctttccttgctactattgtcattgttaccgacacttcagtgtgtcagtctttctatctagtcatgtaattaagaaggaaatttcttattcacctctatccattattattttcatttgaatgcttcgtagtt

SEQ ID NO: 4661 - DNA, 780 bp, Mimulus guttatus
aaaataggctaatacatctctctatattctatcaacccttcttctttcatttttcccctcctgagaaaaaaaaaaagagtaagcagataatatacaacaatggcactgagaatgtgggcttcttctacagccaatgctctgaggctctcttcttcttcttcctcttctagattcgctcctgcattctctctctctagaaccttctctactgtgctggaggggttcaaatatgccacctcacatgaatgggtgaagcacgacggctccatcgccaccattggcatcactgaccatgctcaggaccatttgggagaagtggtgtttgtggagttgccggatggagggaaagcggtggagcaggcgagcagcttcggcgcggtggagagtgtgaaagccaccagtgatatcaactctcccatctccggcgaggtcgtcgaggtcaacaccaagcttaccgagtctcccggtttgataaattcaagcccatatgaagatggatggatgataaaggtgaagccaagcaatccttcagaattggaatctttaatgggaccaaaggagtacactaaattctgtgaagacgaagatgcttctcactaatcatgtcttaattatgtgttttttctttttttaatccaaacttatgttccatttttttatgtattagtaatgtcaagttctggttaattgatttttaaccacttgcatctcttaatttcgatgttaattatgttgatatcatcacccttaatataaaagtaaaaaactggtgaaattatc

SEQ ID NO: 4662 - DNA, 726 bp, Mimulus guttatus
gtgagagaaaattaagcagataatatacaacaacaacaatggcactgagaatgtgggcttcttctacagccaatgctctgaggctctcttcttcttcttcctctagattcgctcctgcattctctctctctagaaccttctctactgtgctggaggggttcaaatatgccacctcacatgaatgggtgaagcacgacggctccatcgccaccattggcatcactgaccatgctcaggaccatttgggagaagtggtgtttgtggagttgccggacggaggcaaagcggtggagcaggcaagcagcttcggcgcggtggagagtgtgaaagccaccagtgatatcaactctcccatctccggcgaggtcgtcgaggtcaacaccaagcttaccgagtctcctggtttgataaattcaagcccatatgaagatggatggatgataaaggtgaagccaagcaatccttcagaattggaatctttaatgggaccaaaggagtacactaaattctgtgaagacgaagatgcttctcactaatcatgtcttaattatcttaattatgtgttttttctttttttaatccaaacttgtgttccatttttttatgtattagtaatgtcaagttctggttaattgatttttaaccactttgcatctcttaatttcgatattaattatgttgatatcatcacccttattataaaagtgaaaaactggtgaaattatc

SEQ ID NO: 4663 - DNA, 781 bp, Mimulus guttatus
aaaataggctaatacatctctctatattctatcaacccttcttctttcatttttcccctcctgagaaaaaaaaaaagagtaagcagataatatacaacaatggcactgagaatgtgggcttcttctacagccaatgctctgaggctctcttcttcttcttcctcttctagattcgctcctgcattctctctctctagaaccttctctactgtgctggaggggttcaaatatgccacctcacatgaatgggtgaagcacgacggctccatcgccaccattggcatcactgaccatgctcaggaccatttgggagaagtggtgtttgtggagttgccggatggagggaaagcggtggagcaggcgagcagcttcggcgcggtggagagtgtgaaagccaccagtgatatcaactctcccatctccggcgaggtcgtcgaggtcaacaccaagcttaccgagtctcccggtttgataaattcaagcccatatgaagatggatggatgataaaggtgaagccaagcaatccttcagaattggaatctttaatgggaccaaaggagtacactaaattctgtgaagacgaagatgcttctcactaatcatgtcttaattatgtgttttttctttttttaatccaaacttatgttccatttttttatgtattagtaatgtcaagttctggttaattgatttttaaccacttgcatctcttaatttcgatgttaattatgttgatatcatcacccttaatataaaagtaaaaaactggtgaaattatca

SEQ ID NO: 4664 - DNA, 703 bp, Prunus persica
aggtgagaatgtgggcttcttctactgccaatgcactcagaatctctagtgcctccaaagcccacctctcccctgcattttctttttccagatgctaggcttctgttctggaagggttgaagtatgcatcttcacatgagtgggtgaagcatgaaggctcagttgcaacaattggtatcactgatcatgctcaggaccatcttggagaagttgtgtttgttgagctgccagaagctggtcgctcagtctctgcaggtgtcggctttggagctgtggagagtgtcaaagcaaccagtgatataaattccccaatttctggtgatgttgttgaggttaactcaaagcttactgaatcacctggtttgatcaattcaagcccatatgaagatggatggatgatcaagattaagcccagcaatccatcagaattagaatccttgttgggtgctaaagaatacacgaagttttgcgaggaagaagatgccgcccactagaatttgaacatgccggtcccaatgatcttgaactaactggttttcagctgtttaaggtttgatgtttcataagaagttgtcatatattatgaaagtactccgggctctaggttcaatttgctttgcttaattatgtccctttctgttgtactatgtatcatctctccaccttttgtctgtacttcatgtgaattaaggttcaaaaaaaa

SEQ ID NO: 4665 - DNA, 936 bp, Cucumis melo
cgaagataaagcaatgtcgtaaaacaaaagtttcaaacatttcttttattctttgctgttaccaaaacagagaaggaagaacaacagaacagagcaaatcaaacaaaaaaaaaaaaaagaagaagtagctatggctcttagaatgtgggcttcttctactgctaatgcactcaaactctcttcttcatctaaaacccatctctctccttcattctctctctccagatgcttctctactgttttggatgggctgaagtatgcttcgtcacatgagtgggtgaagcatgaaggctctgttgctaccgttggcatcactgaccatgctcaggatcatctgggagaagtggtgtttgtggatctgccagaatcaggcagttcagtttctcaaggtaagagctttggagcagtggagagtgtgaaagcaactagtgatatcaactccccaatctctggtgagattgttgaagttaacccgcagcttaaggaaactcctggtttgatcaattcaagtccatatgaagggggatggatgataaaagtgaagccaagcaatccaggtgaattagattctttgcttggtccaaaggaatatacaaagttttgtgaggaagaagatgcagcccactaaagctgaacaaacaaatgtttcatctccaaacagagcttaagctaatttcttttcaaagctgcttgaattgttgacatatcacaagctatttctatgaagaaagagagccaaaataataattacaagtccattgtgagttgaaatgtgcctaagcatctgaactacattctttcttcaatgtttattccacttgaaattaattgaatttctatgccttatttttagccgttaactcttgaatgtgctgaatttgattgaattcatgatactcctaacttttgagttcgatatctatttggttggtcgtt

SEQ ID NO: 4666 - DNA, 725 bp, Triphysaria pusilla
aaataccgccattacggccggaacagtcttaacaacactgaaacaagaaaaaacccatttataagctgaacaataaagaaaccactttgctgtaatttcaagcaatggcactcagagtgtgggcttcttctacagccaatgctttgaagctctcagcttctgcttcacctgctttcactctctccagaagcttttcaactgttttggagggtttgaaatatgctacttcgcatgaatgggtaaagcatgatggcgctatggctacaattggaatcacagaccatgcccaggatcatcttggagaagtggtgtttgtggagttgccagatgcaggcaaaccagtgtcacaagcaaacagttttggagcagtcgaaagtgttaaggcgactagcgatatcaactctcccatctccggtgaggtcgtcgaggtcaacaccaagctatccgactctcccggattgatcaactcaagcccatatgaagatggatggatgataaaagtgaagtctagtaatccttcagaactggaatccttaatgggaactaaagagtatactaagttctgtgaagaagaagatgcttcacactaatgaatccttaatttactgcttttttttgttcaaacttgaatgttcattatttatgcagtatattaatttaatcattctcttgtcagaataagtattgttcaaattagcaaatgcaagttcaagcttcaggttcga

SEQ ID NO: 4667 - DNA, 785 bp, Triphysaria pusilla
gttttggtttaacttagttgtccttaggtattgtaggtcttttctatttttcctaccatccatctaagataataagaaacaccaccatttttcttcattcatattctgcaagtttttaacactgaaaaaaacccatttggctgagcaataaacagagcaaattaaaaaaaacacttttaggataatttgaaacaatggcactcagactgtgggcttcttctacagcaaatgctttgaagctctcatcttctgcttcccctgcttttactctctccagaaccttttcaactgttttggagggttataaatatgctacttcgcatgaatgggtgaaacatgatggctctgtggctaccattggaatcacagaccatgcccaggaccacctaggagaactggtgtttgtagagttgcctgaaccaggcaaatcagtatcccaaggcagcagtttcggagcagtcgagagtgtcaaggcgacgagcgatgtcaactctcccatctccggcgaggtcatcgagttcaacaccaacctatccgactcccccggattgataaattcagggccatatgaagatggatggatgataaaggtgaagcccagtaatccttcagaactggactctttaatggatgctaaagagtatactaaattctgcgaagaagaagatgcttcacactaatgatcactctctgaatatttttaatgtgtttttttagtccaaacttgtgttatcattattgtacgcagtataataatttgctctagtccggttaattaattatta

SEQ ID NO: 4668 - DNA, 653 bp, Malus domestica
agagagaagaaatatggcactgagtttgtgggcttcttctacagccaacgcactcagaatctccactgcctccaaatcccacctctcccctgcattttctctctccagatgcttttctaccgttttggatggattgaagtatgcatcttcacatgagtgggtgaaacatgaaggctcagtggcaacaattggtatcaccgatcatgctcaggaccatcttggagaagtagtgtttgttgagctgccagaatctggtcgttcagtctctcaaggaggcagttttggagctgtggaaagtgtcaaagcaaccagtgatgtaaattccccaatctccggccaagtcgtcgaggttaactcaaagcttaccgaatcacctggtttgatcaattcgagcccctatgaagatggatggatgatcaagatcaagcccagcagtccatcagagctagaatccttgttgggacctaaagaatacacgaaattttgcgaggaagaagatgcagcccattagatataagcatgcagtgaagaccctataatcttgaactaactgatgttcagctgtttaaggttcaattaatgtttgattaagttgttattattatcaaggtactgcaaaatctaaatcaaatgtgctttatttaaaaaaaaaa

SEQ ID NO: 4669 - DNA, 1252 bp, Cucumis melo
  misc_feature (275)..(275): n is a, c, g, or t
tattctttgctgttaccaaaacagagaaggaagaacaacagaacagagcaaatcaaacaaaaaaaaagaaaagaagaagaagtagctatggctcttagaatgtgggcttcttctactgctaatgcactcaaactctcttcttcatctaaaacccatctctctccttcattctctctctccagatgcttctctactgttttggatgggctgaagtatgcttcttcacatgagtgggtgaagcatgaaggctctgttgctaccgttggcatcactgnccatgctcaggatcatctgggagaagtggtgtttgtggatctgccagaatcaggcagttcagtttctcaaggtaagagctttggagcagtggagagtgtgaaagcaactagtgatatcaactccccaatctctggtgagattgttgaagttaacccgcagcttaaggaaactcctggtttgatcaattcaagtccatatgaagggggatggatgataaaagtgaagccaagcaatccaggtgaattagattctttgcttggtccaaaggaatatacaaagttttgtgaggaagaagatgcagcccactaaagctgaacaaacaaatgtttcatctccaaacagagcttaagctaatttcttttcaaagctgcttgaattgttgacatatcacaagctatttctatgaagaaagagagccaaaataataattacaagtccattgtgagttgaaatgtgcctaagcatctgaactacattctttcttcaatgtttattccacttgaaattaattgaatttctatgccttatttttagccgttaactcttgaatgtgctgaatttgattgaattcatgatactcctaacttttgagttcgatatctatttggttggtcgttaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaggggccccccccccccccaaaaactttatcaacccccccaaccccggggggggccccggcccccattccccccaaaagggggccaaataacccccccccccgggcccccttttaaaaccgccgggaggggaaaaacccggggttaccccaattaaaccccttggaaccaatcccccttttccccagggggggaaaaacaaaaaagcccccccccaatccccttccccaacatttcccaacccgaaagggaaaag

SEQ ID NO: 4670 - DNA, 812 bp, Glycine max
aaactttgaaaaaccatatatgaagagctccatcttattgtttcagtgatatattaataataaccaaaacagcagagagaagagaagggctacacaaacacaatctctaatggcactcaggatgtgggcttcttccactgccaatgcactcaaactctcttctgtctccagacctcatctcttgcctcctttttctttctccagatgcttatcttccgtcttggatggacttaagtacgctgattcacatgaatgggtcaagcacgaaggctcagtcgccaccattggtatcactgaccatgcccaggaccatcttggagaggttgtgtatgtggagctgccagaaccaggtggcacagtttccaagaagtctggcttcggagccgttgaaagtgttaaagcaacaagtgatataaactctccaatctcgggggagatcgttgaggttaacaaaaagctcacagaaacgcctggcctggtcaactcaagcccatacgaagatggatggatgatcaaagtaaagccaagcgatccatctgaattagattccttgatgggtccaaaggagtacacaaaattttgtgaggaagaagatgcaagtcattgaagtttgaattgttggctcctgcagttatgtgtgggactgactgttcttcatatgtttatgatcttattaccttctgaacagttttttaatatgcaacagaactgtttctttccatttttccttcccctgctattgtctcttgtcaccgacacttcagtgtgtctacattctaatttctttaataaaaatatttttattaaagata

SEQ ID NO: 4671 - DNA, 736 bp, Juglans hindsii x Juglans regia
  misc_feature (722)..(722): n is a, c, g, or t
aaacaaaacacacactatactacaaaggataaacatggctctcagaatgtgggcttcttccacggccaatgcattcagattctcttatgcctccaaatcccatctctcccctgcgttctctctctcccgctgcttctctaccgtgttggatggtttgaagtatgcatcctcgcatgagtgggtgaagcatgaaggcgctgtggctacaatcggcatcaccgaccatgctcaggaccatcttggagaagtagtgtttgtggaactgccagaagctgggggctcaatatctcaaggtggcagttttggagctgtggaaagtgtcaaagcaaccagtgatgtcaattcccctatctcgggtgagattgttgaggtcaacacaaagcttactgaatcacctggcttgatcaattcaaagccatacgaagatggatggatgatcaaggtgaagccaagcaatccctctgaattagaagccatgatgggtccaaaggaatacacaaaattctgtgaggaggaggatgcttcacattagagtttgaacttttgaaattgctgcatgccggaaagtacatcttggactaattgatcatttagagctgctaaagattgatctgatttgttatgttcttatcatgagttattcttgcatgctttctaccagaccttttacttatcattaaaaaagggtaagaaaattttattaattcttaatgataaaaggntgcttgctcctagg

SEQ ID NO: 4672 - DNA, 809 bp, Catharanthus roseus
cggcacgaggcaccattcatctgagataataaaaaacaagagctcccccaatatttcttgctcaaattgatacaccaaagccagccagctatcagcacttgtgttttgtgtgaagaagcagcagcaaaaaaagcagaagaacatagttatggctttgagaatgtgggcttcttctacggcaaatgccctcaaggtttccacttctagcagagcccttttctcccctgcggccttctctctctccagatgcttttcttctgttcttgatgggctgaaatatgcaccttcccatgaatgggtaaagcacgatggtcctgttgctacaattggcatcacagatcatgctcaggatcatcttggagaagttgtgtttgtggatctaccagaagcaggaggttcagttgataaaggcaaaagttttggaaatgtggaaagtgtaaaagccacaagtgatattaattctccaatctcaggggagattgttgaggtcaatgctaagctcagtgaaacccctggtttgatcaacacaagcccatatgaagatggatggatgataaaagtaaagccaagcagtccagcagaattagaatcattgatgggtgcaaaagaatacacaaaattctgtgaagaagaagatgctgctcactgatcaaaagttaccaacttgtgaagtagtagctaactggtttagccagcttttgagatcttttatgttctttcaagaacttgtcaagtacaaaaaaatgtgtaaaaacatgaattgatcatctttcaatttgctttatgcattgattttgcattaaaaaaaa

SEQ ID NO: 4673 - DNA, 685 bp, Carica papaya
atacatcaaagataaaaccaaaggcaagaaatatatagagagtattgacatagtctgtggcagcagcttttggtggaggagaagaaaaacaaaaagaaaaatggcactcagaatttgggcttcttccaccgctaatgcccttaaactctcctctgctgcctcaaaatctcaccatctctcctctcccttctctctctccaggtgcttctctactgtgttggagggtctgaaatatgcagcttcacatgagtgggtgaaacatgaaggttcagtggctaccattggcatcacccatcatgctcaggagcatttaggggaagttgtgttcgtggagctgccagaaacaggtacttcagttagcaaaggaagcagctttggagcagtagaaagtgtgaaagcaacaagtgatgttaattctccagtttctggtgaagttgtggaggtcaaccaaacacttactggctcacctgccctgatcaattcaagtccatatgaagaaggatggatgatcaaggtgaagcctaacaatccatcagaattagaatctcttatggactccaaggcatacaccaaattctgtgaggaagaagatgcagctcattagaatttaattttgcttcacattttgcctcttaatggaccttgtaatgcttcatctaattcatgtaattaacacttttttctc

SEQ ID NO: 4674 - DNA, 1019 bp, Brassica juncea
tccttccagctttctccatctccagatgcttctcctcagtgttggaaggactcaagtatgcaaattcacatgagtgggtcaaacatgaaggctcagtggctaccattggcatcagtgaccatgcccaggaccatttaggagaagttgtgtttgtggagctgccagaagagaaaagttcagtgagcaaagaaaaaaactttggagcagtggagagtgtaaaggccacaagtgagattatatctccaatctctggtgaagtcattgaggttaacacaaagctcgccgattcacctggtttgattaactcaagcccctacgaagaaggttggatgataaaggtgaaaccaagcaacccagcagagttggaatccttgatgggtccaaaggaatacacaaagttctgcgaagaggaagacgcggctcactagaggattcagagcaaaacaagagaaaccatgcttaaagtttcagttattttttcacttgtcaatgtttctttacatctctctcagcttgtatcagtggtgatataccaatttgattaagatcatgctatgagactcagctgagctttattaaattttaaataagagtggtctaataagcacacaaagaagatatattgattgatgagagacgtttacatatgtgacattaatggtctacttttagaccaaacaaaagcaaagacttggtgctgtacatttactactatccacgacagatactgttggccggtggtgtcgaggaaataggttcatccggtgagtcgtggtcggaaatggaaatcagctctgatctgagctcttccgcatcttccgagtttcttatggtgacggcaggtttcacatctgaggtggttagaggctcttgctccagcgatgaggtgtaagagatgatggcgatgagagactcacgagcttgatcttgagatatatgttgttccatcaaccaaacaatgcctttacacgatttctgggtggtggttagaggctcttgctccagcgatgaggtgtaag

SEQ ID NO: 4675 - DNA, 738 bp, Ricinus communis
caaaaatactacagaaacaagaaaactttagcattaacatggcactcagaatgtgggcgtcttccacagctaatacactaaaaatctctgtagcctgcaaagctcaactctctccttcttactctctttcaagatgcttttcatccgtactagatgggctgaagtatgcaacttcacatgaatgggtgaagcacgaaggttcagtagctacaattggcatcactgaccatgctcaggatcatctgggagaagtagtgtttgtggatctaccagaagctggtacttcagttactcaaggcaagagctttggagctgtggaaagtgtgaaagcaacaagtgatgttaactctccaatctctggtgaggttgttgaagttaacacaaagcttaccgaaggacctggctcgattaattcaagtccatatgaagaaggatggatgatcaaagtgaagccaaacaatccatcagaattagagtccttaatgggtccaaaggaatacacaaaattctgcgaggaagaagatgctgctcattagaaatgtgaacaagcttgcttccatattttcatggactaacttgctttagaaatatttcaagtcccagtgcctgtcaactatcacaatctatctcttatatatgttagcttccagtctcatttttcatttcctcttcctcgtgttttttcttttttctatcttgtgcttctgcaatttcctataactaagaacaaatttctca

SEQ ID NO: 4676 - DNA, 813 bp, Eucalyptus gunnii
cggccggggaagataaaatggtacagaacaaataaaaggctatctctttctctgaaacttgggcactacccaagagcacaggaagcaccactggaggggagcagctaaaccatggcactgaggatgtgggcttcttccaccgccaatgcactcaggctatcttccaaggcctctctctccccagcattctctctccacagatgcttctcctctgttttggatgggctaaagtatgcaccttcgcacgagtgggtgaagcatgaaggcccagtggccagcgtcggcatcactgaccatgctcaggatcaccttggagaagtagtgttcgtggacctgcccgaaccaggcggttcagtttccaaaggaggcagctttggagctgtggaaagtgtaaaagcaaccagtgacattaactctcctatctctggtgagatcgttgaagtgaacacaaagctcactgaaacacccggcttggtcaactcaagcccttatgaagatggatggatgattaaagtgaagcccagtgatccatcggaactaggttccttgatgggtccaaaagagtacacgaaattctgcgaagaagaggatgctgctcattaggatttgaatgtgcatcaaactgacgtctctgaagctgcataagaacgatattttcaatttcttttgttgaatcaattaagacagaactttaaacttcagaaatgtcaatttttctgctttatattccctttctaattttctgcgtgctccttttccccgtgttgtattctgcatcttcatgtaattaagtcacattgccttttcgcttcc

SEQ ID NO: 4677 - DNA, 830 bp, Cajanus cajan
gggggaggcattcgctgcccaccattcatcgaagataaactttgtaaaacatatatgaatcttagtgtttcgaaaaacaataccaaaacagagtgaagagttagagtgatagctagagagacacaacagaagcaacctcagttatctccaatggcactcaggatgtgggcttcttcaactgccaatgcactcaaactctcttctgcctccagacctcatctcttcccttctttctctttctcaagatgcttatctaccgtcttggatggactcaagtacgcagattcacatgaatgggtcaagcatgaaggctcagtcgccaccattggtatcactgaccatgctcaggaccatcttggagaggttgtgtatgtggagctgccagaaccaggtggtgcagttagcaagaagagtggcttcggagcagttgaaagtgttaaagcaacaagtgatataaattctccaatctcgggggagattgttgaggttaacaaaaagctcacagaaactcctggcctggtcaattcaagcccatacgaagatggatggatgatcaaagtaaagccaagtgatccatctgaattacattccttgatgggtccaaaggagtacacaaaattttgtgaggaagaagatgctagtcattaaagtctgaattggctcatgcagttatgaatgttcttcatgtgtttattatgatattattgttattatcttctcaacagttttttaatatgcaatggaactgcttctttccatttttccttccttcccctgctattgtctattgccacgacacttcagtgtgtctacgttctaatttctttaat

SEQ ID NO: 4678 - DNA, 585 bp, Salvia sclarea
accttggctgtcactcaaaaaaaaaacacacacagaggctgaagaagatagctaaaaacaagaaatttgcaatggcactaagaatgtgggcttcttcaacagcaaatgctctgagactctcaacttgtgcttcaaaatctcctgccttttctctctccagagccttttcaactgttttggatgatttgaagtatgcttcttcacatgaatgggtgaagcatgatggtggtgtggccaccattggaatcactgaccatgctcaggagcacttaggagaagtagtgtttgtggagctgccggagtcagggaaggaggtgaagcaaggcagcggctttggggccgtggagagtgtgaaggccactagtgatgtcaactccccgatctccggtgaggtcgttgaggttaacaccaagctaaccgactctcccgggctgattaacacgagcccttatgaagacggctggatgatcaaggtcaagccaaccaacccttcggaccttggaaatttgatgggatccaaagagtacaccaaattctgtgaagaagaagatgccgctcactaatttctttcttttattccttttt

SEQ ID NO: 4679 - DNA, 777 bp, Fragaria vesca
cagcctttgaggtttcagataacccaagcaaacctcacacagacacagaagagagataacgtagcaaaaccatggcactgagaatgtgggcttcttctacagccaatgctctcagaatctctggtggtgcctccaaagctcaactctcccctgcattctctctttccagatgcttttccactgttttggaagggttgaagtatgcatcttcacatgaatgggtgaagcatgaaggttcagttgctacaattggtatcactgaccatgctcaggaccatcttggtgaagtggtgtttgtggagctgccagaaccgggtactgtagtctcccaaagcagcagcttcggaaatgttgaaagtgtgaaagcaaccagtgatgtaaattccccaatctctggtgaggttgttgaggttaacccgaagcttagtgaaacacctggtttgatcaatacaagcccatatgaagatggatggatgatcaaggtgaaacccagcaatccatcagaactagaatccttattgggtgctaaagaatacacgaaattctgcgaggaagaagatgcagcccactagaatgtaatcagacttgcaggccaagtaatcttgaaccgactgattctcagatgtttaagaatcttgtttgacaagttcttgtcaaaatattattacaaaactgcaggttccaagttaaatgtgttttccctcatttccctttcaagtgcactatgtatcatctctctatctctagcctgcattgcttatcttggactatacaaaa

SEQ ID NO: 4680 - DNA, 649 bp, Juglans hindsii x Juglans regia
  misc_feature (633)..(633): n is a, c, g, or t
  misc_feature (648)..(648): n is a, c, g, or t
tatacaagatagcagcatggctctcagaatgtgggcttcttccaccgccaatgcactccgaatttctcgtgcctccagttcccatctctcccctgcattctctctctcccgctgcttctctactgttttggatgggttgaagtatgcatcttctcatgagtgggtgaagcctgaaggcgctgtggccacaatcggcatcactgatcatgctcaggaccatcttggagaagtagtgtttgtggaattgccagaagcaggtggttctgtttctcaaggtagcagcttcggagcagtggaaagtgtcaaagcaaccagtgatgtcaattcccctatctctggtgagattgttgaggtcaacacaaagcttactgaaacaccgggcttgatcaattcaagcccatacgaaggaggatggatgatcaaggtgaagcctagcagtccatcagagttggaatccttgttgggtccaaaagaatatacaaaattctgtgaggaggaggatgctgcacattagaatttgaacttgcagcaggaaacatcttggattgttttctgctacaaaagattaatgttatatttcttatgttcttatcacttgttgctgtttttcactatcaaataacacaaaaaaanggaaaaagttgttcnc

SEQ ID NO: 4681 - DNA, 788 bp, Gossypium hirsutum
gatgaggctttcgttgcccaccattcattcaagataaaacctgcagtgtaaccagaaaccataaacaaaagcactatcacactctttatttcattgccccccttacagatttgcagcccataaacaaagaaatcaaaagacaaaatagccaataacaatggcactcagaatgtgggcttcttccactgccaatgcactcaaaatctcttgttcctccaaacctaatgtttcccttgctttctcactctctagatgcttttccactgttttggatgggctgaagtatgctaattcacatgaatgggtgaagcatgaaggtcctgtggctaccattggcatcactgaccatgctcaggaccatcttggagaagtagtgtttgtggagttgccggaaccaggtggttcagtgagccaaggaaaagggtttggagcagtggaaagtgttaaagcaacaagtgatatcaattccccaatctccggcgaagtcgtggaggttaactccaagctgtccgaaactccgggcctgatcaactcaagcccatatgcagatggatggatgatcaaagtgaagccaagcagtccatcagagttagaatcattgatgggtccaaaggaatacaccaaattctgtgaggaagaagatgcttcccactaagaaaccattgtacccttattttcaaactttgtgttcaagaaataaggtttattgcaatcttaattttatgtctatttatcataacatcttccttcccctctttctagtaatgaaatctttgtttcacttattt

SEQ ID NO: 4682 - DNA, 775 bp, Gossypium hirsutum
ggcacgagccaccattcattcaagacaaaacatgcagtgtaaccagaaaccataaacaaaagcactatcacactctttatttcattgccccccttacagatttgcagcccataaacaaagaaatcaaaagacaaaatagccaataacaatggcactcagaatgtgggcttcttccactgccaatgcactcaaaatctcttgttcctccaaacctaatgtttcccttgctttctcactctctagatgcttttccactgttttggatgggctgaagtatgctaattcacatgaatgggtgaagcatgaaggtcctgtggctaccattggcatcactgaccatgctcaggaccatcttggagaagtagtgtttgtggagttgccggaaccaggtggttcagtgagccaaggaaaagggtttggagcagtggaaagtgttaaagcaacaagtgatatcaattccccaatctccggcgaagtcgtggaggttaactccaagctgtccgaaactccgggcctgatcaactcaagcccatatgcagatggatggatgatcaaagtgaagccaagcagtccatcagagttagaatcattgatgggtccaaaggaatacaccaaattctgtgaggaagaagatgcttcccactaagaaaccattgtgcccttattttcaaactttgtgttcaagaaataaggtttattgcaattttaattttatgtctatttatcataacatcttccttcccctctttctagtaatgaaatctttgtttcactt

SEQ ID NO: 4683 - DNA, 1958 bp, Brassica juncea
caagtacatagtaatagcaccatgggcggtccatagcacatacaggtttgtgactgatgatccggtggatctcggatactccctcgtattacccttcttgctcttcagaattcttcacaaccaggtttggatctctctttcccgttactatacaaccaagggaaagaggcgcatcctggacaaaggtatcgactttaatcaggtcgacagggagaccaactgggatgaccaaatattgttcaacggattactgttctatatagggatcatgctgctgccgcaggcgaagcaacttcccttgtggaggacagacggagtgttgatggcggcgatgcttcacgccgggccggtggagttcctctattattggctccacaaagctcttcaccaccactttctttactcccgctaccattcccaccaccactcctctatcgtcactgaacccatcacttcggtgatacatccatttgcggagcatatagcatacttcattcttttcgccataccattgttgacaacgttgttaacgagaacggcatccatagcgtcgttcgccggatatgtaatctacatagacttcatgaacaacatgggacactgcaacttcgagctcgtccctaagcgccttttccacctctttcctcctctcaagttcctctgctacactccttcattccactcactgcaccacacccaattccggaccaactactccctcttcatgcccttgtatgactacatctacggcacaatggatgaaagctcggatacattgtatgaaaaatctctagaaagaggagaagatagagtggacgtcgtgcacttaactcacctgacgacgcccgagtccatataccatttacggattggcttggcttcatttgcctcccaccccttctcttatagatggttcatgcgccttttgtggcctttcacatctctctccatgctcttcactctcttctacgccagcctctttgtcgctgagagaaactctttcgagaagctcaacttgcagtcttggatcatacccagatataatttgcagtacttgttaaaatggaggaaagacgcgatcaacaacatgattgagaaagcgatactggaggcaaataaaaaaggagtgaaggtgcttagcctgggtctcatgaaccaaggggaggagctaaacaggaacggagaggtgtatattcacaagcatccagaaatgaaagtaagagtggtggacggcagtagattaacagcagccgttgtgatcaatagtctacccaaatcaacgacaaaagtagtgatgacaggcaatctcacaaaggtggcatacaccatcgcctctgctctttgccagagaggtgttgaggttttgactctactaccagaagagtatgagaaactaagatcacttgttccacaagaatgcagagaccgtttggtccttttaacctctgaaacactcgcatcaaacaaggtatggctgatgggagaaggaacaacgagagaggagcaggaaatggccacaaaaggaacgttatttatcccattctcacagttccccctcaagcagttacgaagagattgtatctatcatactccaccggctttaataattccaaaatctctggtcaatatccactcctgtgagaactggttaccgagaaaggcgatgagtgcaactagagtggctggcatattgcacgccttagaaggatgggaaatgcatgagtgcggcacatccaatattcttctctcggatttggaccaagtgtgggaagcttgtctcacccacggcttccagcctctgctgcttccacatcacttccaatacccctgattccctactttcagatgatgaatattgtttccgtaattgatcatatatgatttacagtaagcctctagacaatggatccagaatttcacctctgtattcttagctgatggtttcactcgatctatgg

SEQ ID NO: 4684 - DNA, 2213 bp, Arabidopsis thaliana
agagttgaagagacacagtgacgacacaaacatattacattcgacggtataatggccacaaaaccaggagtcctcaccgattggccttggacacccctcggaagtttcaagtacatcgtaatagcaccatgggctgtccatagcacatacaggtttgtgacagatgatccagagaagagggatctcgggtacttccttgtgttcccattcttgctcttcagaattctgcacaaccaggtttggatctctctgtcccgttactatacgtcctcgggaaagagacgcatcgtcgacaagggaatcgacttcaatcaggtcgacagggagaccaactgggatgaccaaatattgttcaacggagtgctgttctatataggcatcaacctattgccggaggccaaacaacttccctggtggagaactgacggagtgttgatggcagcgcttattcacaccggaccggtggagttcctctattattggctccacaaagctctccaccatcactttctttattcccgctaccattcccaccaccactcctctatcgtcactgagcccatcacttcggtgatacatccgtttgcggagcacatagcatacttcatcctcttcgcgataccactacttaccacgttgctaacaaaaacggcgtcaataatttcgttcgccggatacataatctacatagacttcatgaacaacatgggacactgcaacttcgagctaatccctaagcgccttttccacctctttcctcccctcaagttcctctgttacaccccctcataccactcgctgcaccacacgcagttccggaccaactactccctcttcatgcccttgtatgactacatctacggcacaatggatgaaagcacggatacgttgtacgagaaaactctagaaagaggagatgatatagtggacgtggtgcacttaactcacctgacgacgccagaatccatataccatttgcgcattggcttggcctcatttgcctcctaccccttcgcttatagatggttcatgcgccttttgtggcctttcacctctctctccatgatattcacgctcttctacgcccgcctctttgtcgctgagagaaactccttcaacaagctcaacttgcagtcttgggtgatacctagatataatctacagtacttgttaaaatggaggaaagaagcgatcaataacatgattgagaaagcgatactggaggcagataagaaaggagtgaaggtgcttagtctgggtctcatgaaccaaggggaggagcttaacaggaacggagaggtgtatatccacaaccatccagatatgaaagtgagactggtcgacggcagtagattagcagcagctgttgtgatcaacagtgtacccaaagcaactacaagcgtcgtgatgacaggcaatctcactaaggttgcctacaccatcgcctctgctctctgccagagaggcgttcaggtctccactctgcgcctagacgagtatgagaaaataagatcatgcgttccacaagaatgcagagaccatttggtctatttaacctctgaagcactctcatcaaacaaggtatggctggtgggagaaggaacaacaagagaagagcaggaaaaagccacaaaagggacattgtttataccattctcacagttccccctcaagcagttacgtagagattgtatctatcataccacaccagcattgatagttccaaaatctctggtgaatgtccactcctgtgagaactggttaccgagaaaggcgatgagtgcaactagagtggccggcatattgcacgccttagaaggatgggaaatgcatgagtgtggcacatcccttcttctctcggatttggaccaagtatgggaagcctgtctcagccacggcttccagcctctcctccttccacatcattaaaactccaaccttggaagattttaggagaatgagagcgacacgctctgtgcttcttttccttatgatccagctcttccacgcacaaatgaactatgaaacatatataaagcgcacacatatatttatgcatatcaagcttttggtgattatggtattgatagagtcaaattaagctcggtgactatggtattaataagagtactatttccttttctctttgtgaactaagaaacatatatatataaagcaaacatgttccagaatatctaagtttttcttctccc

SEQ ID NO: 4685 - DNA, 2047 bp, Arabidopsis thaliana
agagttgaagagacacagtgacgacacaaacatattacattcgacggtataatggccacaaaaccaggagtcctcaccgattggccttggacacccctcggaagtttcaagtacatcgtaatagcaccatgggctgtccatagcacatacaggtttgtgacagatgatccagagaagagggatctcgggtacttccttgtgttcccattcttgctcttcagaattctgcacaaccaggtttggatctctctgtcccgttactatacgtcctcgggaaagagacgcatcgtcgacaagggaatcgacttcaatcaggtcgacagggagaccaactgggatgaccaaatattgttcaacggagtgctgttctatataggcatcaacctattgccggaggccaaacaacttccctggtggagaactgacggagtgttgatggcagcgcttattcacaccggaccggtggagttcctctattattggctccacaaagctctccaccatcactttctttattcccgctaccattcccaccaccactcctctatcgtcactgagcccatcacttcggtgatacatccgtttgcggagcacatagcatacttcatcctcttcgcgataccactacttaccacgttgctaacaaaaacggcgtcaataatttcgttcgccggatacataatctacatagacttcatgaacaacatgggacactgcaacttcgagctaatccctaagcgccttttccacctctttcctcccctcaagttcctctgttacaccccctcataccactcgctgcaccacacgcagttccggaccaactactccctcttcatgcccttgtatgactacatctacggcacaatggatgaaagcacggatacgttgtacgagaaaactctagaaagaggagatgatatagtggacgtggtgcacttaactcacctgacgacgccagaatccatataccatttgcgcattggcttggcctcatttgcctcctaccccttcgcttatagatggttcatgcgccttttgtggcctttcacctctctctccatgatattcacgctcttctacgcccgcctctttgtcgctgagagaaactccttcaacaagctcaacttgcagtcttgggtgatacctagatataatctacagtacttgttaaaatggaggaaagaagcgatcaataacatgattgagaaagcgatactggaggcagataagaaaggagtgaaggtgcttagtctgggtctcatgaaccaaggggaggagcttaacaggaacggagaggtgtatatccacaaccatccagatatgaaagtgagactggtcgacggcagtagattagcagcagctgttgtgatcaacagtgtacccaaagcaactacaagcgtcgtgatgacaggcaatctcactaaggttgcctacaccatcgcctctgctctctgccagagaggcgttcaggtctccactctgcgcctagacgagtatgagaaaataagatcatgcgttccacaagaatgcagagaccatttggtctatttaacctctgaagcactctcatcaaacaaggtatggctggtgggagaaggaacaacaagagaagagcaggaaaaagccacaaaagggacattgtttataccattctcacagttccccctcaagcagttacgtagagattgtatctatcataccacaccagcattgatagttccaaaatctctggtgaatgtccactcctgtgagaactggttaccgagaaaggcgatgagtgcaactagagtggccggcatattgcacgccttagaaggatgggaaatgcatgagtgtggcacatcccttcttctctcggatttggaccaagtatgggaagcctgtctcagccacggcttccagcctctcctccttccacatcattaaaactccaaccttggaagattttaggagaatgagagcgacacgctctgtgcttcttttccttatgatccagctcttccacgcacaaatgaactatgaaacatatataaagcgcacacat

SEQ ID NO: 4686 - DNA, 1943 bp, Brassica rapa
  misc_feature (30)..(30): n is a, c, g, or t
  misc_feature (52)..(52): n is a, c, g, or t
  misc_feature (55)..(55): n is a, c, g, or t
  misc_feature (160)..(160): n is a, c, g, or t
  misc_feature (192)..(192): n is a, c, g, or t
acatagtaatagcaccatgggcggtccatngcacatacaggtttgtgactgntgntccggtggatctcggatactccctcgtattacccttcttgctcttcagaattcttcacaaccaggtttggatctctctttcccgtactatacaaccagggaaagngcgcatcctgacaaagggatcatgctgctgcngcaggcgaagcaacttccttgtgagacagacggagtgttgatggcggcgatgcttcacgccgggccggtggagttcctctattattggctccacaaagctcttcaccaccactttctttactcccgctaccattcccaccaccactcctctatcgtcactgagcccatcacttcggtgatacatccatttgcggagcatatagcatacttcattcttttcgccataccattgttgacaacgttgttaacgagaacggcatccatagcgtctttcgccggatatgtaatctacatagacttcatgaacaacatgggacactgcaacttcgagctcgtccctaagcgacttttccacctctttcctcctctcaagttcctctgctacactccttcattccactcactgcaccacacccaattccggaccaactactccctgttcatgcccttgtatgactacatctacggcacaatggatgaaacctcggatacattgtatgagaaatctctagaaagaggagaagatagagtggacgtcgtgcacttaactcacctgacgacgcccgagtccatataccatttgcggattggcttggcttcatttgcctcctaccccttctcttatagatggttcatgcgccttttgtggcctttcacatctctctccatgctcttcactctcttctacgccagcctctttgtctctgagagaaactctttcgagaagctcaacttgcagtcttggatcatacccagatataatctgcagtacttgttaaaatggaggaaagacgcgatcaacaacatgattgagaaagcgatactggaggcaaataaaaaaggagtgaaggtgcttagcctgggtctcatgaaccaaggggaggagctaaacaggaatggagaggtgtatattcacaagcatccagaaatgaaagtaagagtggtggacggcagtagattaacagcagccgttgtgatcaatagtctacccaaatcaacgacaaaaatagtgatgacaggcaatctcacaaaggtggcatacaccatcgcctctgctctttgccagagaggtgttgaggtcttgactctattaccagaagagtatgagaaactaagatcacttgttccacaagaatgcagagaccgtttggtccttttaacctctgaaacactcgcatcaaacaaggtatggctgatgggagaaggaacaacgagagaggagcaggaaatggccacaaaaggaacgttatttatcccattctcacagttccccctcaagcagttacgaagagattgtatctatcatactccaccggctttaataattccaaaatctctggtcaatatccactcctgtgagaactggttaccgagaaaggcgatgagtgcaactagagtggctggcatattgcacgccttagaaggatgggaaatgcatgagtgcggcacatccaatattcttctctcggatttggaccaagtgtgggaagcttgtctcacccacggcttccagcctctgctgcttccacatcacttccaatacccctgattccctactttcagatgatgaatattgtttccgtaattgatcatatatgatttacagtaagcctctagacaatggatccagaatttcacctctgtattcttagctgatggtttcactcgatctatggctgatacaactatatgtttttcaagaaaacctactattttattgcaatgcttgtgttatacattgctgaatatct

SEQ ID NO: 4687 - DNA, 847 bp, Raphanus sativus
aagtctagagagagagagagagagagagagagagagagagagagagagagagttttagacagagagagagaaaaaaatggcgagattcacggtgttgattgcggcagtggtactggccattgtagtggcggtgcctgaagtaactgcgaagaagtacacagtcggcgagaacaagttttggaaccccaacatcaactataccatttgggctcagggaaagcatttctacctcggagactggctctatttcgtgttcgacaggaaccaacacaacattcttgaagtaaacaagaccgactacgaaaactgtaacgccgaccatcctctcgtaaactggacgcgtggagctgggagagacattgtcactctcaacgtgaccaaacattactatctactcgacggaaggggtggctgttacggcggcatgaagctcgctgttaaagtcgagaagcttcctcctccaccgaaagcggcacctgtcaagagcattggttcagtttccatggccactggtgttgctcagttcgtgatcccgtttgctcttttctctgtttccacggtgtgggacgccatcttaaggatgtggtaaatgaccaatgctcggtccgagtcggacctctttagttggaatccattttcgagtttaaagaaacatcaaattctttttcagggaaagcatttttaagttagaaagttcatcagctgagtttatgtttgtaatgttggattgttggtttttaatcttttgttttgtatgtctctttgaaatcaattgttgaaaaatgttgtattttgatttacttgagattgattacatttaattattggaactttcatttaagattga

SEQ ID NO: 4688 - DNA, 862 bp, Raphanus sativus
  misc_feature (813)..(813): n is a, c, g, or t
  misc_feature (825)..(825): n is a, c, g, or t
ggactagtccacctctaaatcacaaattgcgcaactaaacccacaagtctagagagagagagagagagtgagagtgtcaatagagagagagaaaaatggcgagattgacggtgctgattgctgcggtggtactggcttatgtagtggtgatgccagtgccgggagtgaccgcgaagaagtataccgtcggtgacaacaagttctggaacccaaacatcaactacaccatctgggctcagggaaagcatttctacctcggtgactggctctatttcgtgttcgacagaaaccaacacaacattctcgaagtaaacaaaaccgactacgaaaactgcaattccgaccatcctctcgtaaactggacacgtggagcagggagagacgttgtccctctcaacgtgaccaagcactactatctgctcgacggaaagggtggatgttacggaggcatgaagctcgctgttaaagtagagaagctccctcctccaccaaaatctgcacctgtcaagaacattggatcagtctccgtggtcacaggtctcgctcagttcatgattccgtttgccctgttaaggatgtggtaagtgaccaatctcacagtttttttggatcacatccaaattgcaaaaacaaaaacctaaaattctttttcagggaaatcatttaagttagaaatgtccaatcagttcaattttctttatttttgtaatgttttgttttgtttgtgtgtttgaattaattgtctaaaaggggctgtacttgatttattttgctgaaatattaattgttgaaacaatgagagagtgtattatntggatgatgtgngaatgaaatcatataaaaatagaaaattttaaatatg

SEQ ID NO: 4689 - DNA, 829 bp, Arabidopsis thaliana
actagtccatctctctaaatcacaaattgcgcaacttacaacatctatagagagagagagagagagtttagttagagagaaaaaaatggcgagattcacggtgctgattacggcggttgtgctagcttttctaatggcggcgccgatgccaggagtgacggccaagaagtatacagtcggcgagaacaagttttggaaccccaacattaactacaccatctgggctcagggcaagcatttctacctcggagactggctctatttcgtgttcgacagaaaccagcacaatattcttgaagtgaacaagactgactatgaaggatgtatcgccgaccacccaatacgcaactggacacgtggagctgggagagacattgtcactctcaaccagaccaagcattactaccttctcgacggaaagggtggatgttacggtggcatgaagctatctgttaaagtagagaagcttcctcctccaccaaaatctgcacctgtcaagaacattggatcggtttcaatggtcacaggtctcgctcaattcatgattccggtatctctattcgctttccctgcaatgtgggatgtgatctcaaggatgtggtagtagtcaccagtcttcaaagttctttagttgaatcgaaaccgacctcaaaaattcttttcagggaaacctttttaatttagttgagtttctcttttctctttgtaatgttggattgttggttttcctttaatcttttgcctttgaattgattgttaaagaaagattgtatttgatttatttgagaaattaaattactgaaattttcttaagatgcaaaaaaatctc

SEQ ID NO: 4690 - DNA, 783 bp, Arabidopsis lyrata
actagtccgcctctaaatcacaaattgcgcaactcacatccctatagagagagagagagagagagagagagagaaaaatggcgagattgacggtgttgattgtggcggttgcgctagcttttctagtggcggcgccgatgccggaagtgacggcgaagaagtatacagtcggagagaacaagttttggaaccccaacattaactacaccatctgggctcagggcaagcatttctacctcggagactggctctatttcgtgtacgacagaaaccaacacaacattcttgaagtgaacaagactgactatgaaggctgtatcgccgaccacccaatacgtaactggacacgtggagctgggagagacattgtcactctcaacgagaccaaacattactaccttcttgatgggaagggtggctgttatggtggcatgaagctagctgttaaagtcgagaagcttcctcctccaccaaaatctgcacctgtcaagaacattggatcagcttcaatggtcacaggtttcgctcaattcatgattccggtatctcttttcgctttcccggcaatgtgggatgtgatctcaaggatgtggtagtggtgaccagtctcaaagttctttagttgaatcgaaaattcttttcagggaaagcttttaaatttagttgagtttctctttttctctttgtaatgttggattgattgttggtttttaatcttttgtttaattgttgaaaaagattgtaattggtttatttgagaaattaaattactgaaattttctt

SEQ ID NO: 4691 - DNA, 661 bp, Hordeum vulgare
gctgtaccccggggcgacggagagccccgagctgcgctgggcgctcatccggaaggtctacgtcatcctctgcctgcagcttctcctcaccgccgtcgtcgcggtcgtcgtcgtcagggtccgggccatcccgcgcttcttcgtctcgtcctacgccggcctcgggctctacgtcttcctcctcatcctccccttcatcgtgttgtgcccgttgtccatctaccgccagaagcacccagtcaacctgctgctgcttggtgtcttcacagtggccatcagcttctctgtgggcttgacatgtgcctttaacagcggcaaggtcattttggaggctgggattcttacagtggttgttgtcttgagcctcactgtttacaccttctgggctgcgaagaggggcaaggacttcagcttccttgctcctttcctatttgcttctctcagcatgttgctcgtctttgggctcattcagatcttcttcccgctgggcaagctgtctcacacgatctatggtgcgctggcggcgctcatcttcagtggctacattgtctatgacacgaacaacatcatcaagcgttacacgtatgacgactatgtctgggccgccgtctcgctctaccttgacatcatcaatctgttcctgggcctgctgaccctgttt

SEQ ID NO: 4692 - DNA, 1175 bp, Triticum aestivum
gcacgaggctccccactcgccttccgccacacccaagaaaaccctacatccggaggcatcgtcatcgccgggcgagatgaaaggcggcgacattgaggcgggcggcgacgtcgaggcgggcaccgcggcaccgaagggggcgccgtaccccgggacgacagagagcccggagttgcgctgggcgctcatccggaaggtttacgtcgtcctctgcctgcagcttctcctcaccgccgtcgtcgcggtcgtcttcgtcaaggtccgcagcatcccgcatttcttcgcctcctcctacgtcggcctcgggctgtacatcttcatcctcatcttccccttcatcgtgatgtgcccattgcacttctaccgccagaagcacccggtcaacctgctgctgcttggcgtcttcacagtggccatcagcttctctgtgggcttgacatgtgccttcactagtggcaaggtcattttggaggctgggattcttacaatcgtggttgtcttgagcctcactgcttacaccttctgggctgcaaggaggggcaaggactttagcttccttggtcctttcctatttgcttgtctgatgattttgctcgtctttgggttcattcagatcttcttcccgctgggcaagctctctcacatgatctatggcgcgctggcggcactcatcttcattggctacattgtctatgacacgggcaacatcatcaagcgttacaagtatgacgagtatgtctgggccgccgtcacgctctaccttgacatcatcaatctgttcctgggcctgatgaccctgtttagggcgggtgacagctaggcaggtcgccctgcccctactctcgcgtgcttgaaatcccgtcgatgaatttggtatcctgatgagtccttgacatgaagaattgtatagtctgatctgtctcgctggcacggtgaaaatgttgcttactttagttgagtttatccctagtagagaggaaacataagaaaacagtgtgtcgtttccgttctatggatggtggatgtgatgttgtatttagggggtctttgacatgctgggttggtggtgttgcgtttctgatatcatttgtccttgtggcatctggacgagggcaatattgcttcctagcacatatgaattggtctcttggcctgcctagttggtggcgtttgtc

SEQ ID NO: 4693 - DNA, 1112 bp, Triticum aestivum
cccgcgaaaaccctacctccggaggcaacgccgggcaagatgaagggcggcggcgatatcgaggcgggcaccgcggcaccgaaggggacgacggagagccccgagctgcgctgggcgctcatccggaagatctacgtcgtcctctgcctgcagctgctcctcaccgccgccgtcgcggtcgtcttcgtcaaagtcagcagcatcccgcgtttcttcgtctcctcctacgccggcctcgggctgtacgtcttcatcctcgtcttccccttcgtcgtgctgtgcccgctgcacatctaccgccagaagcacccaatcaacttgctgcttcttggcgtcttcacagtggccatcagcttctctgtgggcttgacatgtgcctttaccagtggcaaggtcattttgcaggctgggattcttacaattgtggttgtcttgagcctcactgcttacaccttctgggctgcaaggaggggcaaggacttcagcttccttggtcctttcctatttgcttctctgatgattttgctcgtctttgctttcattcagatcttcttcccgctgggcaagctctctcacatgatctatggcgcgctggcggcactcatcttcagtggctacattgtctatgacacgggcagcatcatcaagcgttacaagtatgacgagtatgtctgggctgccgtcacgctctaccttgacatcatcaatctgttcctgggcctgctgactctgtttagggcgtgtgacaactaggcacgtccccctgcccctgctctctctcgtgcttcaaatcccgtcgacgaatttggtatcctgatgagtccttgacatgaagaattgtatagtctggtctgtctcgctggcacggtgaaaatgttgcttactttagttgagttgatcctatactagtagagagaaaacgtaagaaaaccgtgcgtcggttctatcctatggatggtggatgtgatgctgtatttagacgtgctggattggtcgattggtggtgctgggtttatttagctgggtctttgacatgctggactggtggtgctgggtttatgtagctgcgggcttcggacgagggcaatattgtttcctagcacatatgaatt

SEQ ID NO: 4694 - DNA, 969 bp, Triticum aestivum
  misc_feature (379)..(379): n is a, c, g, or t
  misc_feature (809)..(809): n is a, c, g, or t
gggcggcgacgtcgaggcgggcaccgcggaaccgaaggggacgacggagagccccgagctgcgctgggcgctcatccggaagatctacgtcgtcctctgcctgcagcttctcctcaccgccgccgtcgcggtcgtcttcgtcagggtccgcgccataccccacttcttcgtctcctcctacgccggcctcgggctctacatcttcatcctcatcttccccttcatcgtgacgttcccgttgcacttctaccgccagaagcacccagtcaacctgcttctgcttggcgtcttcacagtggccatcagcttctctgtcggcttgacatgtgccttcactagcggcaaggtcattttggaggctgggattcttacaatcgtngttgtcttgagcctcactgcttacaccttctgggctgcaaggaggggcaaggactttagcttccttggtcctttcctatttgcttctctgatgattttgctcgtctttgggttcattcagatcttcttcccgctgggcaagctctctcatatgatctatggcgcgctggcggcactcatcttcagtggctacattgtctatgacacgggcagcatcatcaagcgttacaagtatgacaagtatgtctgggctgccgtcacgctctaccttgacatcatcaatctgttcctgggcctgctgactctgtttagggcgtgtgacaactaggcacgtcttcctgcccctgctctctcgtgcttcaaatcccgtcgacgaatttggtatcctgatgagtccttgacatgaagaattgtatagtctggtctgtctngctggcacggtgaaaatgttgcttactttagttcagttgattgatccctagtatagaggaaacataagaaaaccgtgcgtcggttctattctatggatggtagatgtgatgttgtatttagggggtctttgacatgctggattggtggtgctgcgtttct

SEQ ID NO: 4695 - DNA, 852 bp, Avena sativa
ttttcctcgctcagctcgctcgctagggtttcctctccaacaatccccaaatccgccccgcgatcccccaaatccaccgatggcggccgcagacggcgagaagaagatgatcaccctcaagtcgtcggacggcgaggagttcgaggtggaggaggcggtggccatggagtcgcagacgatccgccacatgatcgaggacgactgcgccgacaacggcatcccactccccaacgtcaactccaagatcctctccaaggtaatcgagtactgcaacaagcacgtccaggcagccaagcccgtcgccgaaggaggcgcccccgcacccgcacccgccgccgccgacagctcctccgccgcgcccgcacccgccgaggacctcaagaactgggacgccgagttcgtcaaggtcgaccaggccaccctattcgacctcatcctggctgccaactacctcaacatcaagggactgctggaccttacgtgccagactgttgctgacatgatcaagggcaagaccccagaggagatccgcaagaccttcaacatcaagaacgacttcacggctgaggaggaagaggagatccgcagggagaaccagtgggccttcgagtaatctacacgtgcctgccgcgttgatgatgcttagaagttgtcctttcaacgctgctgctgctacttttaatttcgtaatgcttgtaattattttggattcgtggtctggtttgtgaacatcttgactggtggctgtgtctggaacgggaactatctgtcgttggtcagtggtggttataacttgtgcactgaattggtaattgtccaagtggatcttttgcttattaacttccatcatct

SEQ ID NO: 4696 - DNA, 936 bp, Saccharum officinarum
gagaggccaggccgccagggggaaaaagtcagggcgtcccgtcgactcgttttcctcatcacaaatcaatccgccgcgcgccgcagctagtagctagggtttcgtcgcatcagccgattcagcccttcgtcgatccatcgatggcgtccgagggcgacaacaagaagatgatcaccctgaggagctccgacaacgaggagttcgaggtggaggaggcggtggcgatggagtcgcagaccatccgccacatgatcgaggacgactgcgcggacaacggcatcccgctccccaacgtcaactcgaagatcctctccaaggtcatcgagtactgcaacaagcacgtccacgccgccgccaagcccgctgacgccgcggaccgccgccgccgcagggggcggcgaggacctcaagaactgggacgcggagttcgtcaaggtcgaccaggctacgctcttcgacctcatcctggctgccaactatctgaacatcaagggattgctggacctcacctgccagacggtggctgacatgattaagggcaagactccggaggagatccgcaagacgttcaacatcaagaacgacttcacccaagaggaggaggatgagatccgcagggagaaccagtgggccttcgagtgaggtctttcatggtggtggtggtgcggtgctgcttacaagaaagatggatgtctgcaccgcgctctacaatgttattagtgctagtctacttactaaatatatgtggtcgtaatggttgtatgccttttggaggcgggttatggtttggattggatggaggtcaaactgagtgctagttcgtttgtctggagttattattagttaataatattaatttaagtactacatatctcagcaatcaattgtatcttatggtgatttgcccccattgctggtatcttgatgagttgctct

SEQ ID NO: 4697 - DNA, 722 bp, Cenchrus ciliaris
  misc_feature (589)..(589): n is a, c, g, or t
  misc_feature (591)..(591): n is a, c, g, or t
gtccgccgaggccgagaagaagatgatcaccctcaggagctccgacggcgaggagttcgaggttgaggaggcggtcgccatggagtctcagaccatccgccacatgatcgaggacgactgcgccgacaacggcatcccgctccccaacgtcaacgccaagatcctctccaaggtcatcgagtactgcaacaagcacgtccacgccgccaagcccgccgatgacgccgcacccgccgccgccgacgcctccgccggcgccgaggacctcaagaactgggacgccgagttcgtcaaggtcgaccaggccacgctcttcgacctcatcctggctgccaactacctgaacatcaagggattgctggacttgacctgccagacggttgctgacatgatcaagggcaagactccggaagagatccgcaagacattcaacatcaagaatgacttcaccccagaggaggaggaggagatccgcagggagaaccagtgggcatttgagtgattgccgtctttgttggtggcggtgttgcttcaagtgtgcactgcactgctacttagctagttatgctattatctggtcgtaatggtngnaattacttttggtgaacctactactaggtggttattatggcttagatggaggtggaacttgggtggtacgtgaggtttaagctgttatctgcagctagtttattaatatataatactaagtgtcgagtgga

SEQ ID NO: 4698 - DNA, 899 bp, Oryza sativa
cccccaatccaacccccaatctcgccgcaatccccatcgccgccgctgcgaaagctagggtttcgtgcgattcacctcctcggcgacgaccgagaccgcgagcgatttcggagggctcgatcgatggcggctgagggagagaagaagatgatcaccctgaagagctccgacggggaggagttcgaggtggaggaggcggtggcgatggagtcgcagacgatccgccacatgatcgaggacgactgcgccgacaacggcatcccgctccccaacgtcaactccaagatcctctccaaggtcatcgagtactgcaacaagcacgtgcacgccgcggccgccgcggcctccaaggccgccgacgacgccgcgtccgccgccgcagccgtgccgccgccctccggcgaggacctcaagaactgggacgccgacttcgtcaaggtcgaccaggccaccctcttcgacctcatcctggccgcgaactacctcaacatcaaggggttgctggaccttacttgccagactgttgctgacatgatcaaggggaagactcctgaggagatccgcaagaccttcaacatcaagaacgacttcacccctgaggaggaagaggagatccgcagggagaaccagtgggcttttgagtagaaggcatcaaggcctctgatgtcttggtgcttagatccttaccccgtatctacgtatgctctgcttttatatgtcgtgctggttgtaagtattttggagtccgatgggggttcatgtgcacgtttagttggttaaatggttaagttctatccaggaaaaaaagaactgatgtggtcagaactgctgaacctgttatctgcattaattaatactatcaatctgcagtgaaatgctttgctgaaaagtatgtcata

SEQ ID NO: 4699 - DNA, 1086 bp, Zea mays
tataaccgtcagatttatttggacgtgctggattgatcgataccaacttctaacagattgatatgttccgtatatacccacccgaccacccaccccgccgctatccccaatatatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttcgtggtgtctactactatgtctactttatgttgtcctaatggttgtaagtattttgggagtcactttgcttgcgaatgtctcgcgtaagacttatgttggtcaatggtcggttattaacttattaccatgaaagcacttcgtctgctgccctaagaggtttagtcccatttgcattataaccaattcaatccttgtggatgatttgtgtgattccatcgtgaatctcatggtaaaatattttcattgttgtgatactgcctattcgcagtccagttgtattttttgttttttactatttgctgatgttgagtttt

SEQ ID NO: 4700 - DNA, 995 bp, Zea mays
accccgccgcaatccccaatatatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttcgtggtgtctactactatgtctactttatgttgtcctaatggttgtaagtattttgggagtcactttgcttgcgaatgtctcgcgtaagacttatgttggtcaatggtcggttattaacttattaccatgaaagcacttcgtctgctgccctaagaggtttagtcccatttgcattataaccaattcaatccttgtggatgatttgtgtgattccatcgtgaatctcatggtaaaatattttcattgttgtgatactgcctattcgcagtccagttgtattttttgttttttactatttgctgatgttgagtttt

SEQ ID NO: 4701 - DNA, 973 bp, Sorghum bicolor
gcacgccgcacgccgcaatccctaatcgacttccccaatctttcgccctcttcgcgcagcagctacagagctagggttccgtcctcgatccgatccggcgagtgctcaccacctttccccacttccctccgatcgaatcgatggcggccgagggcgaaaagaaaatgataaccctcaaaagctcagatggtgaggagttcgaggtggaggaggcggtggcgatggagtcgcagaccatccgccacatgatcgaagatgactgcgccgacaacggcatcccgctccctaacgtcaactccaagatcctatccaaggtaatcgagtactgcaacaagcacgtacatgccgccgctgccgctgccgcagcctccaaggccggttccgacgacgtgggtgccgccgccgccaacagcaccgccgcctccggtgaggacctcaagaattgggatgctgacttcgtcaaggtcgaccaggccacgctcttcgacctcatcttggctgcaaactatctcaacatcaagggtctgctggacctgacctgccagactgttgctgacatgatcaagggcaaaaccccagaggagatccgcaagaccttcaacatcaagaatgacttcacccctgaggaggaagaggagatccgcagggagaaccagtgggcctttgagtaaggaggtgctgagccctctgatctcttatgcctaggtttcgtcatatctactaccttgcaatgctctgcttttaaatgtcatcgtaatggttgtaagtattttgggagtcactttgcttgagaatgtgttgggtaaaactgatgtggtcaatggtcggttattactatgaaaggacatcggctgctgccctaagaggtcaatcctcgtagatgttttgtgcgattcctccatcttgaatctcttggcgaagtactatcattattgtgatattgcctattcatgagcctcgtgtttgtttacca

SEQ ID NO: 4702 - DNA, 1018 bp, Saccharum officinarum
  misc_feature (45)..(45): n is a, c, g, or t
  misc_feature (53)..(53): n is a, c, g, or t
  misc_feature (57)..(57): n is a, c, g, or t
agtggtccctgcagtacggtcggaatcccgggtcgaccacgcgtncgaaaaanaaanaaaacggaaaaaaagaacccccaatctatcgccctcttcgcgcagcagctgcagagctagggttccgtcctcgatccgatccggcgagtgcacaccacctttccccacatccctccgatcgaatcgatggcggccgagggcgagaagaaaatgataaccctcaaaagctccgatggtgaggagttcgaggtggaggaggcggtggcgatggagtcgcagaccatccgccacatgatcgaagatgactgcgccgacaacggcatcccgctgcctaacgtcaactccaagatcctatccaaggtaatcgagtactgcaacaagcacgtacatgccgccgcagccgctgccgcagcctccaaggccggctccgacgacgtgggtgccgccgccgccaacagcaccgccgcctccggtgaggacctcaagaactgggatgctgacttcgtcaaggtcgaccaggccacgctcttcgacctcatcttggctgcgaactatctcaacatcaagggtctgctggacctgacctgccagactgttgctgacatgatcaagggcaaaaccccagaggagatccgcaagaccttcaacatcaagaatgacttcacccctgaggaggaagaggagatccgcagggagaaccagtgggcctttgagtaaggaggtgctgaaccccctgatctcttgatgcctaggtttcgtcatatctactaccttgcaatgctctgcttttaaatgtcgtcgtaatggttgtaagtattttgggagtcactttgcttgcgaatgtgttgggtaaaactgatgtggtcaatggccggttattaccatgaaaggacttcggctgctgccctaagaggtcaatcctcgtggatgttttgtgcgattcctccatcttgaatctcctggcaaattactatcattattgtgatattgcctattcatgagccacttgtgtttgtttacc

SEQ ID NO: 4703 - DNA, 1131 bp, Saccharum officinarum
ccccaatcgacttccccaatctatcgccctcttcgcgcagcagctgcagagctagggttccgtcctcgatccgatccggcgagtgcacaccacctttccccacatccctccgatcgaatcgatggcggccgagggcgagaagaaaatgataaccctcaaaagctccgatggtgaggagttcgaggtggaggaggcggtggcgatggagtcgcagaccatccgccacatgatcgaagatgactgcgccgacaacggcatcccgctgcctaacgtcaactccaagatcctatccaaggtaatcgagtactgcaacaagcacgtacatgccgccgcagccgctgccgcagcctccaaggccggctccgacgacgtgggtgccgccgccgccaacagcaccgccgcctccggtgaggacctcaagaactgggatgctgacttcgtcaaggtcgaccaggccacgctcttcgacctcatcttggctgcgaactatctcaacatcaagggtctgctggacctgacctgccagactgttgctgacatgatcaagggcaaaaccccagaggagatccgcaagaccttcaacatcaagaatgacttcacccctgaggaggaagaggagatccgcagggagaaccagtgggcctttgagtaaggaggtgctgaaccccctgatctcttgatgcctaggtttcgtcatatctactaccttgcaatgctctgcttttaaatgtcgtcgtaatggttgtaagtattttgggagtcactttgcttgcgaatgtgttgggtaaaactgatgtggtcaatggccggttattaccatgaaaggacttcggctgctgccctaagaggtcaatcctcgtggatgttttgtgcgattcctccatcttgaatctcctggcaaagtactatcattattgtgatattgcctattcatgagccacttgtgtttgtttaaaaaaaaaaaaaaaaaaaaaaaagggccggccgtctagaggatcaagctaccgacgctgcatgcgacggataactctttatagggcacctaaattaattccatggccgcgtttacaacgctgactggaaaaccctgcgttaccaacttatcgccttgagacaatcccttttccgact

SEQ ID NO: 4704 - DNA, 983 bp, Brachypodium distachyon
ctaatcaatcaatctgttcccctttctccccagctcacgagcaaagctagggtttcgtccaccgcgaccgatcggaaaaagcaagcagtggcgatggcggcgatggcggcagagggtgagaagaagatgatcaccctgaagagctccgacggcgaggagttcgaggtggaggagacggtcgcgatggagtcgcagaccatccgccacatgatcgaggacgactgcgccgacaacggcatcccgctccccaacgtcaactccaagatcctctccaaggtcatcgagtactgcaacaagcacgtccacgcgaccgccgccgccaaggccgccaacccctccgacggcgacgccaacccggccgccgccaacaactcctccaccaccgccgcccccggcgaggacctcaagaactgggacgccgactttgtgaaggtcgaccaggccaccctcttcgacctcatcctggctgcaaactatctcaacattaagggattgctggaccttacctgccaaactgttgctgacatgataaagggtaagactcctgaggagatccgcaagaccttcaacatcaagaatgacttcacccctgaggaggaagaggagatccgcagggagaaccagtgggccttcgagtagagaagcacagacctcatcaattgatgcttaggtttcatcatatctaccatgtgaggcgctgctttttatatatgtcgtaatggctgtaagtatgtttggagtcgttttcgtgagaaaaacttatgtggtcagtaccttctgaaccgaatgtccgcagttaatgctactattgtcaagtgggtttcttggctgcaagttttagttctagtatgtgacgccgttgagttcggttttatgtgatgtatctggtctgagtaatcattgtcatcgcaaagatgaaatcttgctcaaatcaaacccgtagtgaacctgtgcttcgggagattttggtccgtaaaccccaa

SEQ ID NO: 4705 - DNA, 1241 bp, Arabidopsis lyrata
atttaaataaaaacagagcttgctttaccaaataccaccgaaacccactaagaatacagcaaatcgtctctccgccattaaaacaccttcctttggacaaaaaagcttcaaacttctctaaacccccaaatcagcaaaaatagggttaatcgaagaacctcaccgtaagtccactgaggattcaagttcttgttttggtttaaggaagaagagcagcaaaaacctcaaggagaagaagtcaaagatgactcagagtcaaaccaacgacggagctggagccggagctgttacgacggtagaagctgttcctcctcagccgcagccgcagccgcagcagcagagcaacgagatggtgttgcatacgggaagtttgagttttagtagccatatgtcgagggaagacgaagagatgactcgttctgctctttcggcgtttagagctaaagaagatgagattgagaagaggaggatggaagttcgtgaacggatccaagctcaattgggtcgggtcgagcaagaaaccaaacgtctctccactattcgtgaggagcttgagtctatggcagatcctatgaggaaggaagtttctgtggttcgtaagaagattgatagtgttaacaaagaactcaaacctttaggttccactgttcaaaagaaggaaagggaatacaaagaagcacttgatacattcaatgagaagaaccgggagaaagttcagctgatcacaaaactcatggagatggaacagttggttggagaaagcgagaagttgaggatgattaagctggaggagctgagcaagagcatagaaaccgtgtgaaaggtgtacaagaactaattgggttctttgtgtgatgatgtacctacctagtttaaatttttcatcttgtaagatgtgtgtatttttaacatttgtgggtgcttttattgttgttagttttgaaagtctttgggggtttgatttgtaaaatttgtgggttctctcttatttttgatttaaccaaattagggatatgggaaaatgggagattcttaggatactgaaactcatcacagtgattattctttctttctctgtattatgtttttgtatttgtctttttgaagaatttatttatttttttttggctttttagtaaagtttcttctcgttggcaaagaagaaaagtgactctcgcgtgcgtttttgaatctaaaagctgtcggaacggcagaatcttttcacttgtttatttgcataa

SEQ ID NO: 4706 - DNA, 1058 bp, Brassica rapa
cccacgcgtccgcagacacgcctccctccgccattaaaacacaacacaagccttcttcttcgagtcagcgacaatagggttacccgaagagccccaccgtaactccaccgaggattcgagctcctgctttgggttaaggaagaagcacaccaaggagaaaccgaagatgactcagaccaacgccggagcttcaaccggagccgccgccgccgcaacgacggagcttcctcctcctcaacctcagccgcagacgcagagaagcgagatggtgttgcacacgggaagcttgagtttcagcagccacatgtcgagagaagacgaggagatgactcgctctgctctctctgcgtttagagctaaagaggatgagatcgagaagaggagggcggaggttcgtgaacggatccaggctcagttgggtcgggtcgaggaagaaacccgacgactctcaacccttcgcgaggagattgagtctatggcagatcctatgaggaaggaagtctctgtggttcgtaagaagattgatagtgttaacaaagaactcaaacctttaggttccaccgttcaaaagaaggaaagggaatacaaggaagcacttgatacattcaacgagaagaacagggagaaagtgcagctgatcaccaaactcatggagatggaacagttggtaggagaaagcgagaagttgaggatgaagaagctggaggagctgagcaagagcattgaagaaaccgtgtgaatgtggttcatgatactaattgggtttaggatcggcttggtttctttgtgtgatgtacctagtttttacatttttttttgcattttgtaacgtgtgtgattgtgggttatttttattttgttaggcttgaaaaatctctgggggttggtttgtaaaatttgtgggttgtcttattttttgattaaccaagttagggagtgtgaaatgggagattatttaggatactgaaactcgtcacagtgaaattatgtttctttgtgttcttgcttctcagtaatttgtttttttgaatttgtcgaattgttttaactatttttgc

SEQ ID NO: 4707 - DNA, 964 bp, Brassica napus
gacagatagtatttcaattccatttaattaaaaatgtttaacaagagaataactcgattccttaaaaaacggtcgtaagacgactaataacatgattaagtataagattaggttaataatgcaattaaacgctgtgcttaatcatttaaaaccaaacacacagaaacacacctttacacaaagaccacttacaatccagacacgcctccctccgccattaaaacacaacacaagccttcttcttcgagtcagcgacaatagggttacccgaagagccccaccgtaactccaccgaggattcgagctcctgctttgggttaaggaagaagcacaccaaggagaaaccgaagatgactcagaccaacgccggagcttcaaccggagccgccgccgccgcaacgacgacggagcttcctcctcctcaacctcagccgcagacgcagagaagcgagatggtgctgcacacgggaagcttgagtttcagcagccacatgtcgagagaagacgaggagatgactcgctctgctctctctgcgtttagagctaaagaggatgagatcgagaagaggagggcggaggttcgtgaacggatccaggctcagttgggtcgggtcgaggaagaaacccgacgactctcaacccttcgcgaggagattgagtctatggcagatcctatgaggaaggaagtctctgtggttcgtaagaagattgatagtgttaacaaagaactcaaacctttaggttccaccgttcaaaagaaggaaagggaatacaaggaagcacttgatacattcaacgagaagaacagggagaaagtgcagctgatcaccaaactcatggagatggaacagttggtaggagaaagcgagaagttgaggatgaagaagctggaggagctgagcaagagcattgaagaaaccgtgtgaatgtggttcatgatactaattggggtttagggtcggct

SEQ ID NO: 4708 - DNA, 952 bp, Brassica rapa
ggagcaaaccaaaaacagagacgccctccgccattaaaacaccctctccaagaaaagcttcttctcaaaaccctcccagatcagcaaacatagggctactcgaagaaccccaccgtaactccaccgaggactcgagttcttgctttggtttgaggaagaagagcagcaaaaaccacaaggagaaaccgaagatgactcagaccaacgccggagctggaaccggagccgccgccacgacggagcctcctcagagcaacgagatggttctgcatactggaagcttgagcttcagcagccatatgtctaaagaagacgaggagatgactcgttctgcgctctctgcgtttaaagctaaagaggatgagattgacaagaggaggatggaagttcgtgaacggatccaggctcagttgggtcgggtcgaggaagaaacccgacgactctccaccattcgcgaggagcttgagtctatggcagatcctatgaggaaggaagtgtctatggttcgtaagaagattgatagtgttaacaaagaactcaaacctctaggttccactgttcaaaagaaggaaagggaatacaaagaagcacttgatacattcaacgagaagaacagggagaaagttcagctgatcaccaaacttatggagatggaacagttggtaggagaaagcgagaagttgaggatgaagaagctggaggagctgagcaagagcattgagaccgtgtgaatgtggttcaagaactaactggctttaggatcgtcggttcgttgtgtgaatgtacctagtttacattttgtgagaagtgtgtattttttaagattgtgggtgtttttgttagttttgaaatatcttggggttggtttgtaaaattaacgaaattagggaggaatgggagattattaggatactgaaactcttcacattgattattttttttcctgttcttg

SEQ ID NO: 4709 - DNA, 953 bp, Brassica oleracea
  misc_feature (530)..(530): n is a, c, g, or t
  misc_feature (553)..(553): n is a, c, g, or t
gaatccagcaaaccaaaacagatacgccctccgccattaaaacaccctctccaagaaaagcttcttctcaaaaccctcccaaatcagcaaacatagggttactcgaagaaccccaccgtaactccaccgaggactcgagttcttgctttggtttgaggaagaagagcagcaaaaaccacaaggagaaagcgaagatgactcagaccaacgccggagctggaactggagccgccgccacgacggagcctcctcagagcgacgagatggttttgcatactggaagcttgagcttcagcagccatatgtctaaagaagacgaggagatgactcgttctgcgctctctgcgtttaaagctaaagaggatgagattgacaagaggaggatggaagttcgtgaacggatccaggctcagttgggtcgggtcgaagaagaaacccgacgactctccaccattcgcgaggagcttgagtctatggcagatcctatgaggaaggaagtgtctatggttcgtaagaagattgatagtgtnaacaaagaactcaaacctctagnttccactgttcaaaagaaggaaagggaatacaaagaagcacttgatacattcaacgagaagaacagggagaaagtgcagctgatcaccaaacttatggagatggaacagttggtaggagaaagcgagaagttgaggatgaagaagctggaggagctgagcaagagcattgagagcgtgtgaatgtggttcaagaactaactgggtttaggatcgtctggttcgttgtgtgaatgtacctagtttacattttgtgagaagtgtgtatttttaagattgtgggtgtttttgttagttttgaaatatcttggggttggtttgtaaaattaacgaaattagagagtgaatgggagattattaggatactgaaactcttcacattgattatttttttttcctgtt

SEQ ID NO: 4710 - DNA, 611 bp, Brassica juncea
ggaaaacaaagaaagcatcgagaaaaaaaagcgcaaaatggcaggaagattgagcggtgtggcctcacggatcatgggcggaaacggcatcgtcgcccgatccaacgcctcttctctccgccaacgcgccggcatgggtctacccgtcggcaaacacatcgtccccgacaagcctctttcggttaacgacgagctgatgtgggacaacgggactgcgtttccagagccttgcattgatcgaattgctgacaccgtcgggaagtatgaagcattgggatggttgtgtggcggtctaggattctttgcgactctcggtatgctcgctgttgtgaatgataaagcttccaaggttccatttacaccacgagtgtatccgtatgacaacctgagagtggagcttggtggagagccatagagacctatcaagtgattagctcatcaaactcgagcgcgttttcttcactgctttgtaattcaaaacttcttttaatttcctgctcaaaacttgcagacaaaagaataaaagagacatcgttttcgtttatatgcgttgtctctgtaactaacagtgaccatttgggtgtactcacgagagaagacatcttgttttt

SEQ ID NO: 4711 - DNA, 704 bp, Brassica juncea
tcaaatccgtacaaaaaaaacaaagctacgaacacttaaaaactgaaacctgaaacaaaagaacgcatcgagaaaagcgaaaatggcaggaagattgagcggtgtggcctcacggatcatgggtggaaacggcatcgttgcccgatccggcgcctcttctctccgccaacgcgccgggatgggtctccccgtcggcaaacacatcgtccccgataagccgctttcggttaacgacgagctgatgtgggacaacgggactgcgttcccagagccttgcatagatcgaatcgctgataccgtcgggaagtatgaagcattgggatggttgtgtggcggtctagggttctttgctactctgggtatgctcgctgttgtgaacgataaagcttcaaaagttccatttacaccacgagtttatccctatgacaacctgagagtggagcttggaggagacccatagagacctatcgagtgatctagtcgagcgtgttttcattcacgcttttgttcttcaaaatgttttcgtttccttcctcagaacttggtgagaaaaagaataaaagagatttttttttttgttttattgtgtgttgtctctataattaacagtgaccatttgggtgtgtattcataagagaagacatgtgcttttcagcaaaatttgtgttggattgtgtctacacaagtgaacacgaagcagtagc

SEQ ID NO: 4712 - DNA, 698 bp, Theobroma cacao
cgggggaaagtgagaggaaaaaaaaatggcaggaagattgagcaacgtcgcgtcgcggatcatgggcggaaacggcatcgtttcgcgctccgtcgcctcctctcttcgcctccgttctggcatgggcctccctgtgggcaaacacatcgtgccggacaagccccttcctgtaaatgacgagctaatttgggacaatggaacttcatttccagaaccttgtatagatcgaatcgccgatactgtcggaaagtatgaggcattggcttggatgtgtggaggtttgagcttctttgcatcgttgggattattagcttggtggaatgacaaagcctctaagattccattcacaccaaaagtatatccatatgacaacttgcgggtggagctgggtggagaaccataggtagatccttgtacgagcaataatacagttattgttgtttcacatatgtccttgtttgttcatttgtgtacttttggaactcagaaacagttaaataatggattgcgttggtttcttgcccaaacgaacattttgaacaaatagcctaatgtggtttggcgcagaactcgttgaagatcttattataagaatgcattgcctcctttccttttttcagtttggtgttgaatttcggcagaatcacaaattgatgtgtgattacagtgttacataatatgatattgaaaatcatcga

SEQ ID NO: 4713 - DNA, 628 bp, Catharanthus roseus
  misc_feature (363)..(363): n is a, c, g, or t
  misc_feature (536)..(536): n is a, c, g, or t
ggcacgaggcaacatactcggagctaactaagaaatataaagtactgttctctagtcggagaaaatccgatcggtaacaatggctgccagattgagccacgtagcatcgcgtattatgggcggcaacggtattgtatcccgttccgtcgattcctctcttcgtctccgctcaggcatgggtcttcccgtcggcaaacacatcgtccctgacaagcccctgccggtgaatgatgaattagtgtgggataacgggactccatttccggaaccttgcatcgaccgaattgctgatactgtcggaaagtatgaagcgctggcttggtgggctagcgggttagggtttttcgtaacacttggactttnggctaggtggaatgacaaagcttcaaaaatcccttatgtgccaaaggtctatccatatgacaacctaagggaggagcttggtggagaaccatagttatctgattcctgctagatgtgcagatgagttgcttatgggtcttcttgtgtatttcttttgttatttcaaataaatngtatgaaatgctcaatcctgaaccaataacatcattgatcaagtagctgaattttaatttgcttaaagccatcattgggtggattttctttt

SEQ ID NO: 4714 - DNA, 1336 bp, Brassica napus
attctcgttttctgatctcaaacttacaaatggcgaacggagccggtagagtggatctggacggcaaaccgataaagccgatgacgatatgcatgatcggcgccggaggtttcatcggctcgcacctctgcgagaagctcctaacggagactccgcacaaggtgctcgcgctcgacgtgtacaacgacaagatcaagcacttgctggagccggatactgccgagtggaaagatcggatccagttccatcgcatcaacatcaagcatgattccaggctcgaaggactcgtcaagatggcggatctgactattaatcttgcggcgatctgtactccggctgattacaatacgcgtcctcttgataccatctacagcaacttcattgacgcgcttccagttgttaagtactgctctgagaacaacaagcgtctcattcacttttctacctgtgaaatttatggtaaaaccattggaagcttccttcccaaggatcatcctctacgcgaggatccttctttctatgttcttaaagaagatgtttctccttgcatatttggttcaattgagaagcaaaggtggtcatacgcgtgtgcaaagcagttgattgagagactcgtttacgctgagggtgctgagaatggacttgagttcaccattgtgagaccttttaactggattggacctaggatggatttcatccccggcattgatggtcctagcgaaggtgtccctcgtgttctcgcctgctttagtaataatcttcttcgccgtgagcctctgaagcttgtggacggtggagaatcacagaggacttttatctacatcaaggatgctatcgaagctgttcttttgatgatcgaaaaccccgagagggccaatgggcatatattcaatgtaggcaacccgaacaacgaagtcacagtacgacagcttgctgaaatgatgaccgaggtatacgcaaaagtgagtggagagggagcaatagagagcccgacggtggatgtaagctcaaaagagttttacggggaaggttatgatgacagtgacaagagaatcccagacatgaccatcatcaaccgccaacttggatggaacccgaagacatctctgtgggacttgctggaatcgaccttaacctatcagcacaggacttatgcagaagctgtgaagaaggcaacatccaaaccagtagcttcctaaaatgttacaagtcccccagttatcaacacagacgccctgattaggcttttttaagaactctattcgattctttgttttttctacatctcattgactctttttttttacatttcttgttgagaaaacaatattattac

SEQ ID NO: 4715 - DNA, 1570 bp, Raphanus sativus
  misc_feature (829)..(829): n is a, c, g, or t
  misc_feature (1448)..(1448): n is a, c, g, or t
  misc_feature (1547)..(1547): n is a, c, g, or t
ggaagatacttctaacgagatttgcttcctttcacatgctcctctcccactcataaatatctccaccgtcaccactctctctctctctctacactttacagccaattgttatctcatagagagagaaagcgcgggattctcgaaacgattcctctctcgtagtttctgatctcaaaaattctcaaaaatggcgaacggagccggaagagtggatctggacggcaggccgataaagccgatgacgatatgcatgatcggcgccggaggtttcatcggctctcacctctgcgagaagctcctgaacgagactccacacaaggtgctcgcgctcgacgtgtacaacgataagatcaagcacttgctggagcaggatacggtcgagtggaaggatcggatccagttccaccgcatcaacatcaagcacgattccaggctcgaaggactcgtcaagatggcggatctgactataaatcttgcagcgatctgtactccagcggattacaatacgcgtcctcttgatactatctacagcaacttcattgacgcgcttccagttgttaagtactgctctgagaacaacaagcgtctcattcacttctctacctgtgaagtatatggcaaaaccattggaagctttcttcccaaggatcatcctctccgcgaggatccttctttttatgttcttaaagaagatgtttccccttgcatatttggttcaattgagaagcaaaggtggtcatacgcttgtgcaaagcagttgattgagagactcgtttacgctgagggtgctgagaatggactcgagttcaccattgtgagaccttttaantggattggacctaggatggatttcatccccggcattgatggtcctagcgaaggtgtccctcgtgttctcgcctgctttagtaataatcttcttcgccgtgagcctctgaagcttgtggatggtggagaatcgcagagaacttttatctacatcaaggatgctatcgaagctgttcttttgatgatcgaaaacccggagagggccaatgggcatatattcaatgtaggcaacccgaacaacgaagtcacagtacgacagcttgctgaaatgatgaccgaggtttacgcaaaagtgagtggagagggagctatagagagcccgacggttgatgtaagctcaaaagagttttacggggaaggttatgacgacagtgacaagagaatcccagacatgaccatcataaaccgccaactgggatggaacccgaagacatctctgtgggacttgctggaatcgaccttaacctatcagcacaggacttacgcagaagctgtgaagaaggcaacatccaaaccagtagcttcctaagatgttacaagtccaacagttcatcaacacactcattaaagacgccctgattttggcatttttaaaaactctattcgattcttttcttttnacatcccatagactctttttttacctttcttcttaagaaaacaaccttgttacgctggtccgttgttctcaaatataccgtctattttttgttctcctncaagctggtgtctttggccatta

SEQ ID NO: 4716 - DNA, 1422 bp, Brassica napus
caatggcgaacggagccgttagattggatctggacggaaagccgatcaagcccctcacgatctgcatgatcggcgccggaggtttcatcggctctcacctctgcgagaagctcctgaccgagactccgcacaaggtcctcgcgctcgacgtctacaacgacaagatcaagcacttgctcgagcccgatacttccgagtgggccgagaggatccagtttcaccgcatcaacatcaagcacgattcgaggctcgagggactcgtgaagatggcggatctgacgattaatctcgctgcgatttgtactccggctgattacaatacgcgtccgcttgatactatctacagcaacttcatcgatgctctccctgtggttaagtactgctcagagaacaacaagcgtcttattcacttctccacctgtgaggtgtatgggaaaactataggaagctttcttcctaaggatcatcctctgcgtcaggatcctgatttttatgtactcaaagaagatacatccccttgcatttttggttccattgagaagcagaggtggtcatatgcttgtgcgaagcaactgattgagagactcgtctacgctgagggtgctgagaacggacttgagttcaccattgtaagaccgtttaactggattggacctaggatggatttcatccctggcattgatggtcctagcgagggtgtccctcgtgtcctggcctgctttagcaacaaccttctgcgacgtgaacctctgaagcttgtggatggtggagaatcacagagaaccttcatctacatcaaggatgctattgaggctgtcctcctgatgattgaaaacccagagagagccaatgggcatatcttcaatgtaggtaacccaaacaatgaagtgacagtaagacaacttgctgaaatgatgactaaggtctactcaaaagtgagtggagagacagcaattgagagtccaacaatagacgtgagctccaaagaattttatggagagggttatgatgacagcgacaagagaatcccagacatgaccatcatcaaccgtcaacttggatggaacccgaagacgtctctttgggacttgcttgagtcgaccttaacttaccagcacaggacctacgctgaagccgttaagaaggccacctcaaaaccagtcgcatcttagaggtggtccatcatcacctcgaatcatttggtggctacttccttttctttctttttttaatacacccagtattcccttaaaacaggccattctaagcgagtgatatatatcatggtcgttggttctagtttgcgcgttattgcttatatagtatatgctaatgtctttaatttcgttgttgaagcttaatatctttgtactttgtccgaaactaaaaaaaaagaatggtttgttcaaaactacaacgttc

SEQ ID NO: 4717 - DNA, 1536 bp, Arabidopsis thaliana
atccaccgtcaccactctctcttcctctttagattctctctctacagagaacttgattattttttctgatctgagaaaaaaaatggcgaatggagctaatagagtggatctcgacgggaaaccgatacaaccgttgacaatatgcatgatcggcgccggaggtttcatcggttcacatctctgtgaaaagctcttgaccgagacgccacataaggtgcttgcgctcgatgtttacaacgataagatcaaacacttgcttgagcctgataccgttgaatggagtggtcggatccagtttcatcgtatcaatattaagcatgattcgagacttgaaggtcttgttaagatggcggatctgattataaatcttgctgcgatctgtactccagctgattacaatacacgtcctcttgatactatctacagcaatttcattgatgcgcttccagttgtgaaatactgttctgagaacaacaagcgtctcattcacttttctacctgtgaagtttatggaaaaaccattggaagctttcttcctaaggatcatcctctgcgtgatgatcctgctttctatgttcttaaagaagatatttccccttgcatatttggttcaattgagaagcagaggtggtcatatgcgtgtgcaaagcaactgattgagagacttgtttacgctgagggtgctgagaatgggcttgagttcaccatcgtacgaccttttaactggattggacctaggatggatttcatccccggcattgatggtcctagcgaaggtgtcccacgtgtccttgcctgctttagtaacaatcttctacgtcgtgagcctctcaagcttgtagatggtggagaatcacagagaactttcgtctacatcaatgatgctattgaagctgtccttttgatgattgaaaacccagagagggcaaatgggcacatcttcaacgtaggcaacccgaacaacgaagttacagtaagacagctcgctgaaatgatgaccgaggtttacgcaaaagtgagtggagaaggagccattgagagcccaacggttgatgttagctccaaagagttttacggggaaggttatgatgacagtgacaagagaatcccagacatgaccatcattaaccgccaactcggatggaacccgaaaacatcgctatgggacttgctcgagtcgaccttaacctaccagcacaggacatacgctgaagctgtgaagaaggcaacatccaaaccagtggcttcctaaactctccaagaccccaacgaaactcgttaaacacgcgtcattttggcattttactctattcgattctatttttttcatcccagagaaaactttttttcttttttctttttaagaaaacgatataatcacggtggttcgttccaagtataccttttcgtttgtaagttttctctttttgtttggtttgtttggccatgtatgtcggagctgtcagaaagcaagaggttaatcgtttgtagcgaatgataaatgttcgagtgtatattttaaaatgcttcgtttta

SEQ ID NO: 4718 - DNA, 1549 bp, Arabidopsis thaliana
atccaccgtcaccactctctcttcctctttagattctctctctacagagaacttgattattttttctgatctgagaaaaaaaatggcgaatggagctaatagagtggatctcgacgggaaaccgatacaaccgttgacaatatgcatgatcggcgccggaggtttcatcggttcacatctctgtgaaaagctcttgaccgagacgccacataaggtgcttgcgctcgatgtttacaacgataagatcaaacacttgcttgagcctgataccgttgaatggagtggtcggatccagtttcatcgtatcaatattaagcatgattcgagacttgaaggtcttgttaagatggcggatctgattataaatcttgctgcgatctgtactccagctgattacaatacacgtcctcttgatactatctacagcaatttcattgatgcgcttccagttgtgaaatactgttctgagaacaacaagcgtctcattcacttttctacctgtgaagtttatggaaaaaccattggaagctttcttcctaaggatcatcctctgcgtgatgatcctgctttctatgttcttaaagaagatatttccccttgcatatttggttcaattgagaagcagaggtggtcatatgcgtgtgcaaagcaactgattgagagacttgtttacgctgagggtgctgagaatgggcttgagttcaccatcgtacgaccttttaactggattggacctaggatggatttcatccccggcattgatggtcctagcgaaggtgtcccacgtgtccttgcctgctttagtaacaatcttctacgtcgtgagcctctcaagcttgtagatggtggagaatcacagagaactttcgtctacatcaatgatgctattgaagctgtccttttgatgattgaaaacccagagagggcaaatgggcacatcttcaacgtaggcaacccgaacaacgaagttacagtaagacagctcgctgaaatgatgaccgaggtttacgcaaaagtgagtggagaaggagccattgagagcccaacggttgatgttagctccaaagagttttacggggaaggttatgatgacagtgacaagagaatcccagacatgaccatcattaaccgccaactcggatggaacccgaaaacatcgctatgggacttgctcgagtcgaccttaacctaccagcacaggacatacgctgaagctgtgaagaaggcaacatccaaaccagtggcttcctaaactctccaagaccccaacgaaactcgttaaacacgcgtcattttggcattttactctattcgattctatttttttcatcccagagaaaactttttttcttttttctttttaagaaaacgatataatcacggtggttcgttccaagtataccttttcgtttgtaagttttctctttttgtttggtttgtttggccatgtatgtcggagctgtcagaaagcaagaggttaatcgtttgtagcgaatgataaatgttcgagtgtatattttaaaatgcttcgttttacatgtgtacaagt

SEQ ID NO: 4719 - DNA, 1572 bp, Brassica napus
tccagtcacggttaatcagctgatatcgaattctatcggtattacggccggggagagcgtgtgacaaaagatccaacgcgtttctctgattcctttcctccatcctccaccgacaaacaaacaatggcgaacaacggagccgttagattggatctggacgggaagccgatcaagccgatcacgatctgcatgatcggcgccggcggtttcatcggctctcacctctgcgagaagctcctgaacgagactccgcacaaggtcctcgcgctcgacgtctacaacgacaagatcaagcacttgctcgagcctgatacctccgagtgggccgagaggatccagttccatcgcatcaacatcaagcatgactcgaggctcgaggggctcgtcaagatggcggatctgacgattaatttggctgcgatctgtacaccagcggattacaatacgcgtcctcttgacactatctacagcaattttatcgatgctctccctgtggtgaagtactgctcagagaacaacaagcgtcttattcacttctccacttgtgaagtgtatgggaaaaccattggtagctttcttccgaaggatcatcctctgcgtcaggatcctgatttttatgtactcaaagaagatacatctccttgcatttttggttctattgagaagcagaggtggtcatatgcttgtgctaagcaactgattgagagacttgtctatgctgagggtgctgagaacggacttgagttcaccattgtgagaccgtttaactggattggacctaggatggatttcatccctggcattgatggtcctagcgagggtgtccctcgtgtcctagcctgcttcagcaacaaccttctgaggcgtgagcctctcaagcttgtggatggtggagagtcgcagagaaccttcatctacatcaaggatgccattgaagctgtcctcttgatgattgaaaacccagagagagccaatgggcatatcttcaatgtaggaaacccaaacaatgaagtgacagtaaggcagcttgccgaaatgatgactaaggtctactcaaaagtgagtggagagacagctattgagagtccaactgtagacgtgagctccaaagaattctatggagaaggttatgatgacagcgacaagagaatcccagacatgaccatcattaaccgtcaacttggatggaacccgaagacgtctctttgggacttgctcgagtcgaccttaacttaccagcacaggacctatgctgaagctgttaagaaggccacttcaaaaccagtcgcgtcttagaggtcaccatcacctcgaaccattcggcggctactatttcccattatttttgttttcttactcaatattcccttaatatagaccacacttctgtaagcgaatgatgatatcatggtggttggttctagtttattgctatatagtattactgttaaatgtttttgaattcgtcgttgaagcttgatatcttgtatttgtcccaaaaaacaaaactaaaaaagagaatggtttgtcaaaactataacgttcatttgtaacgaaaaaaaaaaaaaaaaa

SEQ ID NO: 4720 - DNA, 1500 bp, Brassica napus
aatccgggatgacggccattacggccggggatagcgtgtgacaacagatccaacgcgtttctctgattcctttcctccaccgacaatggcgaacaacggagccgttagattggatctggacgggaagccgatcaagccgctcacgatctgcatgatcggcgccggcggtttcatcggctctcacctctgcgagaagctcctgaacgagactccgcacaaggtcctcgcgctcgacgtctacaacgacaagatcaagcacttgctcgagcctgatacctccgagtgggccgagaggatccagttccatcgcatcaacatcaagcatgactcgaggctcgaggggctcgtcaagatggcggatctgacgattaatttggctgcgatctgtacaccagcggattacaatacgcgtcctcttgacactatctacagcaatttcatcgatgctctccctgtggttaagtactgctcagagaacaacaagcgtctgatccacttctccacttgtgaagtgtatgggaaaaccattggtagctttcttccaaaggatcatcctctgcgtcaggatcctgatttttatgtactcaaagaagatacatctccttgcatttttggttctattgagaagcagaggtggtcatatgcttgtgctaagcaactgattgagagacttgtctatgctgagggtgctgagaatggacttgagttcaccattgtgagaccgtttaactggattggacctaggatggatttcatccctggcattgatggtcctagcgagggtgtccctcgtgtcctagcctgcttcagcaacaaccttctgaggcgtgagcctctcaagcttgtggatggtggagagtcgcagagaaccttcatctacatcaaggatgccattgaagctgtcctcttgatgattgaaaacccagagagagccaatgggcatatcttcaatgtaggaaacccaaacaatgaagtgacagtaaggcagcttgccgaaatgatgactaaggtctactcaaaagtgagtggagagacagctattgagagtccaactgtagacgtgagctccaaagaattctatggagaaggttatgatgacagcgacaagagaatcccagacatgaccatcattaaccgtcaacttggatggaacccgaagacgtctctttgggacttgctcgagtcgaccttaacttaccagcacaggacctatgctgaagctgttaagaaggccacttcaaaaccagtcgcgtcttagaggtcaccatcacctcgaaccattcggcggctactatttcccattatttttgttttcttactcaatattcccttaatatagaccacacttctgtaagcgaatgatgatatcatggtggttggttctagtttattgctatatagtattactgttaaatgtttttgaattcgtcgttgaagcttgatatcttgtatttgtcccaaaaaacaaaactaaaaaagagaatggtttgttaagttaaa

SEQ ID NO: 4721 - DNA, 1446 bp, Brassica napus
aacgcgtttctctgattcctttcctccatccaccgacaatggcgaacaacggagccgttagattggatctggacggaaagccgatcaagccgctcacgatctgcatgatcggcgccggaggtttcatcggctctcacctctgcgagaagctcctgaccgagactccgcacaaggtcctcgcgctcgacgtctacaacgacaagatcaagcacttgctcgaccctgatacttccgagtgggccgagaggatccagtttcatcgcatcaacatcaagcacgattctcgcctcgagggactcgtcaagatggcagatctgacgattaatctcgctgcgatttgtactccggctgattacaatacgcgtccgcttgatactatctacagcaacttcatcgatgctctccctgtggttaagtactgctcagagaacaacaagcgtttgattcacttttccacttgtgaggtgtatgggaaaactataggaagctttcttcctaaggatcatcctctgcgtcaggatcctgatttttatgtactcaaagaagatacatccccttgcatttttggttctattgagaagcagaggtggtcttatgcttgtgcgaagcaactgattgagagacttgtctacgctgagggtgctgagaacggacttgagttcaccattgtaagaccgtttaactggattggacctaggatggatttcatccctggcattgatggtcctagcgagggtgtccctcgtgtcctggcctgctttagcaacaaccttctgcgacgtgaacctctgaagcttgtggatggtggagaatcacagagaaccttcatctacatcaaggatgctattgaggctgtcctcctgatgattgaaaacccagagagagccaatgggcatatcttcaatgtaggcaacccaaacaatgaagtgacagtaagacaacttgctgaaatgatgactaaggtctactcaaaagtgagtggagagacagcaattgagagtccaacaatagacgtgagctccaaagaattttatggagagggttatgatgacagcgacaagagaatcccagacatgaccatcatcaaccgtcaacttggatggaacccgaagacgtctctttgggacttgcttgagtcgaccttaacttaccagcacaggacctacgctgaagccgttaagaaggccacctcaaaaccagtcgcatcttagaggtggtccagcatcacctcgaatcatttggtggctacttccttttcttttctttttttaatacacccagtatttccttaaaacaggccatcctaagtgagtgatatatatcatggtcgttggttctagtttgcgcattattgcttatatagtatatgctaatgtctttaatttcgttgctgaagcttaatatctttgtactttgtccgaaactaaaaaaaaagaatggcttgtt

SEQ ID NO: 4722 - DNA, 1431 bp, Brassica rapa
atagcgtgtgacaacagatccaacgcgtttctctgattcctttcctccatccaccgacaatggcgaacaacggagccgttagattggatctggacgggaagccgatcaagccgcttacgatctgcatgatcggcgccggcggtttcatcggctctcacctctgcgagaagctcctgaacgagactccgcacaaggtgttggccctcgacgtctacaacgacaagatcaagcacttgctcgagcctgatacctccgagtgggccgagaggatccagttccatcgcatcaacatcaagcatgactcgaggctcgaggggctcgtcaagatggcggatctgacgattaatctggcggcgatctgtacaccggcggattacaatacgcgtcctcttgacactatctacagcaacttcatcgatgctctccctgtggttaagtactgctcagagaacaacaagcgtctgattcacttctccacttgtgaagtgtatgggaagaccattggtagctttcttccaaaggatcatcctctgcgtcaggatcctgatttttatgtactcaaagaagatacatctccttgcatttttggttctattgagaagcagaggtggtcatatgcttgtgctaagcaactgattgagagacttgtctatgctgagggtgctgagaatggacttgagttcaccattgtgagaccgtttaactggattggacctaggatggatttcatccctggcattgatggtcctagcgagggtgtccctcgtgtcctagcctgcttcagcaacaaccttctgaggcgtgagcctctcaagcttgtggatggtggagaatcacagagaacattcatctacatcaaagatgccattgaagctgtcctcttgatgattgaaaacccagagagagccaatgggcatatcttcaacgtaggaaacccaaacaatgaagtgacagtaaggcagcttgcggaaatgatgaccaaggtctactcaaaagtgagtggagagacagctattgagagtccaactatagatgtgagctccaaagaattctatggagaaggttatgatgacagcgacaagagaatcccagacatgaccatcattaaccgtcaacttggatggaacccgaagacgtctctttgggacttgcttgagtcgaccttaacttaccagcacaggacctatgctgaagctgttaagaaggccacttcaaaaccagtcgcatcttagaggtcatcgtcacctcgaaccatttggcggctactatttcctattatttttgttttcttactcaatattcccttaatataagaccacacttctctaagcgaatgatgatatcatggtggttggttctagtttatagtattactgttaatgtttttgaattcgtcgttgaagcttgatatatctttgtatttgtcccaaa

SEQ ID NO: 4723 - DNA, 1479 bp, Brassica napus
aacgcgtttctctgattcctttcctccaccgacaatggcgaacaacggagccgttagattggatctggacgggaagccgatcaagccgctcacgatctgcatgatcggcgccggcggtttcatcggctctcacctctgcgagaagctcctgaacgagactccgcacaaggtcctcgcgctcgacgtctacaacgacaagatcaagcacttgctcgagcctgatacctccgagtgggccgagaggatccagttccatcgcatcaacatcaagcatgactcgaggctcgaggggctcgtcaagatggcggatctgacgattaatttggctgcgatctgtacaccagcggattacaatacgcgtcctcttgacactatctacagcaatttcatcgatgctctccctgtggttaagtactgctcagagaacaacaagcgtctgatccacttctccacttgtgaagtgtatgggaaaaccattggtagctttcttccaaaggatcatcctctgcgtcaggatcctgatttttatgtactcaaagaagatacatctccttgcatttttggttctattgagaagcagaggtggtcatatgcttgtgctaagcaactgattgagagacttgtctatgctgagggtgctgagaatggacttgagttcaccattgtgagaccgtttaactggattggacctaggatggatttcatccctggcattgatggtcctagcgagggtgtccctcgtgtcctagcctgcttcagcaacaaccttctgaggcgtgagcctctcaagcttgtggatggtggagaatcacagagaaccttcatctacatcaaagatgccattgaagctgtcctcttgatgattgaaaacccagagagagccaatgggcatatcttcaatgtaggaaacccaaacaatgaagtgacagtaaggcagcttgcggaaatgatgactaaggtctactcaaaagtgagtggagagacagctattgagagtccaactatagatgtgagctccaaagaattctatggagaaggttatgatgacagcgacaagagaattccagacatgaccatcatcaaccgtcaacttggatggaacccgaagacgtctctttgggacttgcttgagtcgaccttaacttaccagcacaggacctatgctgaagctgttaagaaggccacttcaaaaccagtcgcatcttagaggtcatcgtcacctcgaaccatttggcggctactatttcctattatttttgttttcttactcaatattcccttaatataagaccacacttctctaagcgaatgatgatatcatggtggttggttctagtttatagtattactgttaatgtttttgaattcgtcgttgaagcttgatatatctttgtatttgtcccaaaaacaaaactaaaaagagaatcgtttgttaagttaaaactataacagtcctatgttaaaaaaaaaaaaaaaaga

SEQ ID NO: 4724 - DNA, 1432 bp, Brassica rapa
  misc_feature (90)..(90): n is a, c, g, or t
tgttgctataccgacgaacccaaaagcatccatccatcatcatcaatccacatgtctttataaatatcacacccattttgattccattgntaagagatcatcaccgactaaagcaatggcgaacggagccgttagattggatctggacggaaagccgatcaagccgctcacgatctgcatgatcggcgccggaggtttcatcggctctcacctctgcgagaagctcctggccgagactccgcacaaggtcctcgcgctcgacgtctacaacgacaagatcaagcacttgctcgaccctgatacttccgagtgggccgagaggatccagtttcatcgcatcaacatcaagcacgattctcgcctcgagggactcgtcaagatggcagatctgacgattaatctcgctgcgatttgtactccggctgattacaatacgcgtccgcttgatactatctacagcaacttcatcgatgctctccctgtggttaagtactgctcagagaacaacaagcgtttgattcacttttccacttgtgaggtgtatgggaaaactataggaagctttcttcctaaggatcatcctctgcgtcaggatcctgatttttatgtactcaaagaagatacatccccttgcatttttggttctattgagaagcagaggtggtcttatgcttgtgcgaagcaactgattgagagacttgtctacgctgagggtgctgagaacggacttgagttcaccattgtaagaccgtttaactggattggacctaggatggatttcatccctggcattgatggtcctagcgagggtgtccctcgtgtcctggcctgctttagcaacaaccttctgcgacgtgaacctctgaagcttgtggatggtggagaatcacagagaaccttcatctacatcaaggatgctattgaggctgtcctcctgatgattgaaaacccagagagagccaatgggcatatcttcaatgtaggcaacccaaacaatgaagtgacagtaagacaacttgctgaaatgatgactaaggtctactcaaaagtgagtggagagacagcaattgagagtccaacaatagacgtgagctccaaagaattttatggagagggttatgatgacagcgacaagagaatcccagacatgaccatcatcaaccgtcaacttggatggaacccgaagacgtctctttgggacttgcttgagtcgaccttaacttaccagcacaggacctacgctgaagccgttaagaaggccacctcaaaaccagtcgcatcttagaggtggtccagcatcacctcgaatcatttggtggctacttccttttcttttctttttttaatacacccagtatttccttaaaacaggccatcctaagtgagtgatatatatcatggtcgttggttctagtttgcgcattattgctta

SEQ ID NO: 4725 - DNA, 1570 bp, Raphanus sativus
  misc_feature (123)..(123): n is a, c, g, or t
  misc_feature (1461)..(1461): n is a, c, g, or t
tttttttttgccataccgacgaacccaaaagtatcccatcaatccacatgtcttttaaatatctctctcttccacacccattttgattccattgctatcttcgtagcgtgagagatatcatcncgcggcttctctctctctctctccccccaccgacaaaaatacaatggcgaacgcggccgttagattggatctggacggaaagccgatcaagccgatcacgatctgcatgatcggcgccggaggtttcatcggctctcacctctgcgagaagctcctgaacgagactccacacaaggtcctcgcgctcgacgtctacaacgacaagatcaagcacttgctcgagcctgacacttccgagtgggcggagaggatccagttccatcgcatcaacatcaagcatgattctaggctcgagggactcgtcaagatggcagatctgacgatcaatctcgcagcgatctgtacaccggctgattacaatacgcgtcctcttgacactatctacagcaacttcatcgatgctctccctgtggttaagtactgctcagagaacaacaagcgtcttattcacttttccacctgtgaagtgtatgggaaaactattggaagctttcttcctaaggatcatcctctgcgtcaggatcctgaattttacgtactcaaagaagatgcatccccttgcatttttggctctattgagaagcagaggtggtcatatgcttgtgcgaagcaactgattgagagacttgtctacgctgagggtgctgagaacggacttgagttcaccattgtaagaccgtttaactggattggacctaggatggatttcatccctggcattgatggtcctagcgagggtgtccctcgtgtcctagcctgctttagcaacaaccttctgcggcgtgaacctctcaagcttgtggatggtggagaatcgcagagaaccttcatctacatcaaggatgcaattgaagctgtcctcctgatgattgaaaacccagagagagccaatgggcatatcttcaacgtaggtaacccgaacaatgaagtgacagtaagacaacttgctgaaatgatgactaaggtttactcaaaagtgagtggagagacagcaattgagagtccaacgatagacgtgagctccaaagaattttatggagagggttacgatgatagtgacaagagaatcccagacatgaccatcatcaaccgtcaacttggatggaacccgaagacttctctttgggacttgctcgagtcgaccttaacttaccagcacaggacctatgcggaagccgttaagaaggccacctcaaaacctgtcgcttcttagaggtccatcatcacttcgaatcatttggtggctactattccattctttttttgtttttttttaattcacccatatcactaaaaacaggccagttcatgcgagtgatacatcatggtcgttggttntagtttacgcgttattgctatatagtatatgttaatgtctttaaattcgttgttgacgcttttatatctttgtactttggccgaaactaaaaaaaggaattgttttttt

SEQ ID NO: 4726 - DNA, 1411 bp, Brassica juncea
aacggagccgttagattggatctggacgggaagccgatcaagccgctcacgatctgcatgatcggcgccggcggtttcatcggctctcacctctgcgagaagctcctgaacgagactccgcacaaggtgttggccctcgacgtctacaacgacaagatcaagcacttgctcgagcctgatacctccgagtgggccgagaggatccagttccatcgcatcaacatcaagcatgactcgaggctcgaggggctcgtcaagatggcggatctgacgattaatttggcggcgatctgtacaccagcggattacaatacgcgtcctcttgacactatctacagcaatttcatcgatgctctccctgtggttaagtactgctcagagaacaacaagcgtctgattcacttctccacttgtgaagtgtatgggaaaaccattggtagctttcttccaaaggatcatcctctgcgtcaggatcctgatttttatgtactcaaagaagatacatctccttgcatttttggttctattgagaagcagaggtggtcatatgcttgtgctaagcaactgattgagagacttgtctatgctgagggtgctgagaacggacttgagttcaccattgtaagaccgtttaactggattggacctaggatggacttcatccctggcattgatggtcctagcgagggtgtccctcgtgtcctggcctgctttagcaacaaccttctgcgacgtgaacctctgaagcttgtggatggtggagaatcacagagaaccttcatctacatcaaagatgctattgaagctgtccttctgatgattgaaaacccagagagagccaatgggcatatcttcaatgtaggtaacccaaacaatgaagtgacagtaagacaacttgctgaaatgatgactaaggtctactcaaaagtgagtggagagacagcaattgagagtccaacaatagacgtgagctccaaagaattttatggagagggttatgatgacagcgacaagagaatcccagacatgaccatcatcaaccgtcaacttggatggaacccgaagacgtctctttgggacttgcttgagtcgaccttaacttaccagcacaggacctatgcggaagctgttaagaaggccacctcaaaaccagtcgcatcttagaggtccatcatcacctcgaatctggtggctgctattcgattctttttgtatttttttttaaattcacccagtatcccttaaaacaggccattctaagcgagtgagatcatggtcgttggttctagtttacccgttattgctatattagtatatgttaatgtctttacattcgttgttgaagctttatatctttgtactttgtccgttactaaaaagtaaaaagggaatggtttgttcaaaactaaaa

SEQ ID NO: 4727 - DNA, 1404 bp, Brassica oleracea
  misc_feature (430)..(430): n is a, c, g, or t
  misc_feature (451)..(451): n is a, c, g, or t
  misc_feature (643)..(643): n is a, c, g, or t
  misc_feature (788)..(788): n is a, c, g, or t
  misc_feature (793)..(793): n is a, c, g, or t
  misc_feature (799)..(799): n is a, c, g, or t
  misc_feature (814)..(814): n is a, c, g, or t
  misc_feature (820)..(820): n is a, c, g, or t
  misc_feature (853)..(853): n is a, c, g, or t
  misc_feature (868)..(868): n is a, c, g, or t
  misc_feature (883)..(883): n is a, c, g, or t
  misc_feature (898)..(898): n is a, c, g, or t
  misc_feature (949)..(949): n is a, c, g, or t
  misc_feature (976)..(976): n is a, c, g, or t
  misc_feature (979)..(979): n is a, c, g, or t
  misc_feature (985)..(985): n is a, c, g, or t
  misc_feature (998)..(998): n is a, c, g, or t
  misc_feature (1003)..(1003): n is a, c, g, or t
  misc_feature (1025)..(1025): n is a, c, g, or t
  misc_feature (1045)..(1045): n is a, c, g, or t
gatagtatagcgtgtgacaaaagatccaacgcgtttctctgattcctttcctccatcctccaccgacaaacaaacaatggcgaacaacggagccgttagattggatctggacgggaagccgatcaagccgatcacgatctgcatgatcggcgccggcggtttcatcggctctcacctctgcgagaagctcctgaacgagactccgcacaaggtcctcgcgctcgacgtctacaacgacaagatcaagcacttgctcgagcctgatacctctgagtgggccgagaggatccagttccatcgcatcaacatcaagcatgactcgaggctcgaggggctcgtcaagatggcggatctgacgattaatttggctgcgatctgtacaccagcggattacaatacgcgtcctcttgacactatctacagcaatttnatcgatgctctccctgtggtnaagtactgctcagagaacaacaagcgtcttattcacttctccacttgtgaagtgtatgggaaaaccattggtagctttcttccgaaggatcatcctctgcgtcaggatcctgatttttatgtactcaaagaagatacatctccttgcatttttggttctattgagaagcagaggtggtcatatgcttgtgcnaagcaactgattgagagacttgtctacgctgagggtgctgagaacggacttgagttcaccattgtgagaccgtttaactggattggacctaggatggatttcatccctggcattgatggtcctagcgagggtgtccctcgtgtcntagcntgcttnagcaacaaccttctnaggcgngagcctctcaagcttgtggatggtggagagtcncagagaaccttcatntacatcaaggatgcnattgaagctgtcctnttgatgattgaaaacccagagagagccaatgggcatatcttcaatgtaggnaacccaaacaatgaagtgacagtaagncancttgcngaaatgatgactnaggtntactcaaaagtgagtggagagncagctattgagagtccaacngtagacgtgagctccaaagagttttatggagaaggttatgatgacagcgacaagagaatcccagacatgaccatcataaaccgtcaacttggatggaacccgaagacttctctctgggacttgttggagtcgaccttgacttaccagcacaggacctatgcggaagctgttaagaaggccacttcaaaaccagtcgcatcttagaggtcatcatcacctcgaaccatttggtggctactgctccattatttttgcttcttcttttataattcacccattatccccttaaaataggccattgtaagcgaatgattataatttcatatggtgtttggaactagctttcgtttttttttttt

SEQ ID NO: 4728 - DNA, 1430 bp, Brassica napus
  misc_feature (1429)..(1430): n is a, c, g, or t
aacggagccgttagattggatctggacgggaagccgatcaagccgatcacgatctgcatgatcggcgccggcggtttcatcggctctcacctctgcgagaagctcctgaacgagactccgcacaaggtcctcgcgctcgacgtctacaacgacaagatcaagcacttgctcgagcctgatacctccgagtgggccgagaggatccagttccatcgcatcaacatcaagcatgactcgaggctcgaggggctcgtcaagatggcggatctgacgattaatttggctgcgatctgtacaccagcggattacaatacgcgtcctcttgacactatctacagcaatttcatcgatgctctccctgtggttaagtactgctcagagaacaacaagcgtctgatccacttctccacttgtgaagtgtatgggaaaaccattggtagctttcttccaaaggatcatcctctgcgtcaggatcctgatttttatgtactcaaagaagatacatctccttgcatttttggttctattgagaagcagaggtggtcatatgcttgtgctaagcaactgattgagagacttgtctatgctgagggtgctgagaatggacttgagttcaccattgtgagaccgtttaactggattggacctaggatggatttcatccctggcattgatggtcctagcgagggtgtccctcgtgtcctagcctgcttcagcaacaaccttctgaggcgtgagcctctcaagcttgtggatggtggagaatcacagagaaccttcatctacatcaaagatgccattgaagctgtcctcttgatgattgaaaacccagagagagccaatgggcatatcttcaatgtaggaaacccaaacaatgaagtgacagtaaggcagcttgcggaaatgatgactaaggtctactcaaaagtgagtggagagacagctattgagagtccaactatagatgtgagctccaaagaattctatggagaaggttatgatgacagcgacaagagaattccagacatgaccatcatcaaccgtcaacttggatggaacccgaagacgtctctttgggacttgcttgagtcgaccttaacttaccagcacaggacctatgctgaagctgttaagaaggccacttcaaaaccagtcgcatcttagaggtcatcgtcacctcgaaccatttggcggctactatttcctattatttttgttttcttactcaatattcccttaatataagaccacacttctctaagcgaatgatgatatcatggtggttggttctagtttatagtattactgttaatgtttttgaattcgtcgttgaagcttgatatatctttgtatttgtcccaaaaacaaaactaaaaaagagaatggtttgttaagttaaagctataacagtcctatgttcattttctcnn

SEQ ID NO: 4729 - DNA, 1391 bp, Brassica napus
acggagccgttagattggatctggacggaaagccgatcaagcccctcacgatctgcatgatcggcgccggaggtttcatcggctctcacctctgcgagaagctcctgaccgagactccgcacaaggtcctcgcgctcgacgtctacaacgacaagatcaagcacttgctcgagcctgatacctccgagtgggccgagaggatccagtttcaccgcatcaacatcaagcacgattctcgcctcgagggactcgtcaagatggcagatctgacgattaatctcgctgcgatttgtaccccggctgattacaatacgcgtccgcttgatactatctacagcaacttcatcgatgctctccctgtggttaagtactgctcagagaacaacaagcgtttgattcacttctccacttgtgaggtgtatgggaaaactataggaagctttcttcctaaggatcatcctctgcgtcaggatcctgatttttatgtactcaaagaagatacatccccttgcatttttggctccattgagaagcagaggtggtcatatgcttgtgcgaagcaactgattgagagactcgtctacgctgagggtgctgagaacggacttgagttcaccattgtaagaccgtttaactggattggacctaggatggatttcatccctggcattgatggtcctagcgagggtgtccctcgtgtcctggcctgctttagcaacaaccttctgcgacgtgaacctctgaagcttgtggatggtggagaatcacagagaaccttcatctacatcaaggatgctattgaggctgtcctcctgatgattgaaaacccagagagagccaatgggcatatcttcaatgtaggtaacccaaacaatgaagtgacagtaagacaacttgctgaaatgatgactaaggtctactcaaaagtgagtggagagacagcaattgagagtccaacgatagacgtgagctccaaagaattttatggagagggttatgatgacagcgacaagagaatcccagacatgaccatcatcaaccgtcaacttggatggaacccgaagacgtctctttgggacttgcttgagtcgaccttaacttaccagcacaggacctacgctgaagccgttaagaaggccacctcaaaaccagtcgcatcttagaggtggtccatcatcacctcgaatcatttggtggctacttccttttctttcttttttttaatacacccagtattcccttaaaacaggccattctaagcgagtgatatatatcatggtcgttggttctagtttgcgcgttattgcttatatagtatatgctaatgtctttaatttcgttgttgaagcttaatatctttgtactttgtccgaaactaaaaaaaaagaatg

SEQ ID NO: 4730 - DNA, 1419 bp, Raphanus sativus
  misc_feature (15)..(15): n is a, c, g, or t
  misc_feature (107)..(107): n is a, c, g, or t
  misc_feature (122)..(122): n is a, c, g, or t
  misc_feature (129)..(129): n is a, c, g, or t
  misc_feature (390)..(390): n is a, c, g, or t
acaatggcgaacggngcggccgttagattggatctggacggcaaaccgatcaagccgctcacgatctgcatgatcggcgccggcggattcatcggctctcacctctncgagaagctcctgancgagacnccgcacaaggtgctcgcgctcgacgtctacaacgacaagatcaagcacctcctcgagcctgacacctccgagtgggccgagaggatccagttccaccgcatcaacatcaagcatgattcgaggctcgaggggctcgtcaagatggcagatctgacgatcaatctcgctgcgatctgtacgccagcggattacaatacgcgtcctcttgacactatctacagcaatttcatcgatgctctccctgtggttaagtactgctcngagaacaacaagcgtcttattcatttctccacttgtgaagtgtatgggaaaactattggtagctttcttccaaaggatcatcctctgcgtcaggatcctgatttttatgtactcaaagaagatacgtctccttgcatttttggttctattgagaagcagaggtggtcatatgcttgtgctaagcaactgattgagagacttgtctatgctgagggtgctgagaacggacttgagttcaccattgtgagaccgtttaactggattggacctaggatggatttcatccctggcattgatggtcccagcgagggtgtccctcgtgtcctagcgtgcttcagcaacaaccttctgaggcgcgagcctcttaagcttgtggatggtggtgaatcacagagaactttcatctacatcaaagatgccattgaagctgtcctcttgatgattgaaaacccagagagagccaatgggcatatcttcaatgtaggaaacccaaacaatgaagtgacagtaaggcagcttgcggaaatgatgactaaggtctactcaaaagtgagtggagagacggctatagagagtccaactatagatgtgagctccaaagaattctatggagaaggttatgatgacagcgacaagagaatcccagacatgaccatcatcaaccgtcaacttggatggaacccgaagacatctctttgggacttgcttgagtcgaccttaacataccagcacaggacctatgctgaagctgttaagaaggccacttcaaaaccagtcgcatcttagaggtcatcatcacctcgaaccatttggcggctactatttccattatttttgtttctacacaatatttcccttaataggccactcactctaagcgaatgatatatcatatggtggttggttctagttaacgttttattgttatatagagtattactgttaatgtttttgagttcgttgttgaagctttatatctttgtatttgtccccaaaaacaactaaaaaaaagagaatggtttgtttaaa

SEQ ID NO: 4731 - DNA, 1511 bp, Brassica napus
tctctccctctctcccatcacccattgattacactttcaccgacaaacaatggcgaacggagccgatcgattggatctggacggcaggccgatcaagccgctgacgatatgcatgatcggcgccggcggcttcatcggctctcacctctgcgagaagctcatgaacgagactccgcacaaggtcctcgcgctcgacgtgtacaacgacaagatcaagcacttgctcgagccggatacttctcagtgggccgagaggatccagttccatcgcatcaacatcaagcatgattcgagactcgagggactcgtcaagatggcggatctgacgattaatttggctgcgatctgtacgccagcggattacaatacgcgtcctcttgacactatctacagcaatttcatcgatgctctccctgtggttaagtactgctctgagaacaacaagcgtttgattcacttctccacttgtgaagtctatggcaaaactattggatcctttcttcccaaggatcatcctctccgtcaggatcctgatttttatgtacttaaagaagatacatccccttgcatatttggttctattgagaagcagaggtggtcatatgcttgcgccaagcagctgattgagagacttgtctacgctgagggtgctgagaacggacttgagttcactattgtgagaccgtttaactggattggacctaggatggatttcatccctggcattgatggtcctagcgagggtgtccctcgtgtcctagcatgttttagcaacaaccttctgaggcgtgagcctctcaagcttgtggatggtggagaatcacagagaaccttcatctacatcaaagatgctattgaagctgtccttctgatgattgaaaacccagagagagccaatgggcatatcttcaatgtaggcaacccaaacaatgaagtgacagtaagacaacttgctgaaatgatgactcaggtgtactcaaaagtgagtggagagacggctattgagagtccaacggtagacgtgagctccaaagagttttatggagaaggttatgatgacagcgacaagagaatcccagacatgaccatcatcaaccgtcaacttggatggaacccgaagacttctctctgggacttgctagagtcgaccttaacttaccagcacaggacctatgcggaagctgttaagaaggccacttcaaaaccagtcgcatcttagaggtcatcttctcctcgaaccatttggtggctactactccattatttttgcttcttcttttataattcacccattatccccttaaaataggccattgtaagcgaatgattataatttcatatggtgtttggtactagttttcgttttttttttgttacatagtatttacagataatgtcttttgaatgcgttgttgaaagctttatatctttgtattttgtccgaaactaaaaagggaatggtgtgtccgaactataacattcatctgttaacaactggtctttcattctca

SEQ ID NO: 4732 - DNA, 1693 bp, Arabidopsis thaliana
tttctttctttcttttctcccattctcacaaatctctcttccacccattgttatctctgtagaagcgtgagagagatcacgcgtattcaccgacacaatcaaaatatggcgaacggagccgatagattggatctggacggtaaaccgattaagccgatgacgatatgcatgatcggtgccggaggtttcattggctctcatctctgtgagaagcttatgacggagactcctcacaaggttcttgcgcttgatgtttacaatgataagatcaagcacttgcttgagcctgataccgttcaatgggctggtcggatccagtttcatcgtatcaacattaagcatgattctagactcgaaggactgatcaagatggcagatctgacgataaatctagctgcgatctgtactcccgcagattacaatacgcgtcctcttgacactatctacagcaatttcattgatgctctcccagtggttaaatactgctcagagaacaacaagcgtctgattcacttttccacttgtgaagtgtatggaaaaactataggaagctttcttccaaaggatcatcctctgcgtcaggatcctgaattttatgtactcaaagaagatatatccccttgcatctttggttcaattgagaagcagaggtggtcatatgcttgtgcaaagcaacttattgagagacttgtttacgctgagggtgctgagaatggactcgagttcaccattgtaagaccattcaactggattggacctaggatggatttcatccctggcattgatggtcctagcgagggtgtcccacgggttctagcgtgctttagtaacaatcttctgcgacgggagcctctcaagcttgtggatggtggagaatcacagagaaccttcatctacatcaaagatgctatcgaagctgtccttttgatgatcgaaaatccagagagagccaatgggcatatcttcaatgtaggcaacccaaacaatgaagtgacagtgagacaacttgctgaaatgatgactgaggtctacgccaaagtgagtggagagacagctatcgagagtccaacgatcgacgtgagctccaaagagttttatggagaaggttatgatgacagcgacaagagaatcccagacatgaccatcatcaaccgtcaacttggatggaacccgaagacgtcgctttgggacttgcttgaatcgaccttaacataccagcacacgacttatgcggaagccattaagaaggccacttcaaaaccagtcgcatcttagaggtcgtctctctttacaaacacctcaaatcatgtggtggctacgattccattctttctttttaaaaaaaaaattctcccaacagaaaccttctcttcccttattttaggccattctaaacaaatgatatatcatggtggttgattctagtttacgttttccttgttatatagtattactgttaatgtttttgaattcctttgttttgaagctttatatcttgtatttgtccgaaactaaaaagggaatggtttgtgcaaactataacattggggctttctttatatgttacatatctttggcggattccacacttcacttctatatctgcctggttgtaataaacgagttagtttggcttttgctcgtgttgctgtgttatgtgaatatataccttaattagaaatgcctaaggtct

SEQ ID NO: 4733 - DNA, 1686 bp, Arabidopsis thaliana
tttctttctttcttttctcccattctcacaaatctctcttccacccattgttatctctgtagaagcgtgagagagatcacgcgtattcaccgacacaatcaaaatatggcgaacggagccgatagattggatctggacggtaaaccgattaagccgatgacgatatgcatgatcggtgccggaggtttcattggctctcatctctgtgagaagcttatgacggagactcctcacaaggttcttgcgcttgatgtttacaatgataagatcaagcacttgcttgagcctgataccgttcaatgggctggtcggatccagtttcatcgtatcaacattaagcatgattctagactcgaaggactgatcaagatggcagatctgacgataaatctagctgcgatctgtactcccgcagattacaatacgcgtcctcttgacactatctacagcaatttcattgatgctctcccagtggttaaatactgctcagagaacaacaagcgtctgattcacttttccacttgtgaagtgtatggaaaaactataggaagctttcttccaaaggatcatcctctgcgtcaggatcctgaattttatgtactcaaagaagatatatccccttgcatctttggttcaattgagaagcagaggtggtcatatgcttgtgcaaagcaacttattgagagacttgtttacgctgagggtgctgagaatggactcgagttcaccattgtaagaccattcaactggattggacctaggatggatttcatccctggcattgatggtcctagcgagggtgtcccacgggttctagcgtgctttagtaacaatcttctgcgacgggagcctctcaagcttgtggatggtggagaatcacagagaaccttcatctacatcaaagatgctatcgaagctgtccttttgatgatcgaaaatccagagagagccaatgggcatatcttcaatgtaggcaacccaaacaatgaagtgacagtgagacaacttgctgaaatgatgactgaggtctacgccaaagtgagtggagagacagctatcgagagtccaacgatcgacgtgagctccaaagagttttatggagaaggttatgatgacagcgacaagagaatcccagacatgaccatcatcaaccgtcaacttggatggaacccgaagacgtcgctttgggacttgcttgaatcgaccttaacataccagcacacgacttatgcggaagccattaagaaggccacttcaaaaccagtcgcatcttagaggtcgtctctctttacaaacacctcaaatcatgtggtggctacgattccattctttctttttaaaaaaaaaattctcccaacagaaaccttctcttcccttattttaggccattctaaacaaatgatatatcatggtggttgattctagtttacgttttccttgttatatagtattactgttaatgtttttgaattcctttgttttgaagctttatatcttgtatttgtccgaaactaaaaagggaatggtttgtgcaaactataacattggggctttctttatatgttacatatctttggcggattccacacttcacttctatatctgcctggttgtaataaacgagttagtttggcttttgctcgtgttgctgtgttatgtgaatatataccttaattagaaatgcct

SEQ ID NO: 4734 - DNA, 1581 bp, Raphanus sativus
  misc_feature (98)..(98): n is a, c, g, or t
  misc_feature (1580)..(1580): n is a, c, g, or t
ggagatccctcattttctgctctttcccattctctctcacaagcctccctccctctctctctcctccacacccaattgattacattgtaactactagngaatagagatcacgcgtttctatctccaccgacaacaacaatggcgaacggagccgatcgattggatctggacgggaggccgatcaagccgatgacgatatgcatgatcggcgccggtggattcatcggctctcacctctgcgagaagctcatgaacgagactccgcacaaggtcctcgcgctcgacgtctacaacgacaagatcaagcacttgctggagcctgatacttctcagtgggccgagcggatccagttccaccgcatcaacatcaagcacgattccagactcgagggactcgtcaagatggcagatctgacgatcaatctagctgcgatctgtacaccagcggattacaatacgcgtcctcttgacactatctacagcaatttcatcgacgctctccctgtggttaagtactgctctgagaacaacaagcgtttgattcacttctccacttgtgaagtctatgggaaaactataggaagctttcttcccaaggatcatcctctgcgtcaggatcctgatttttatgtactcaaagaagatacatccccttgcatatttggttctattgagaagcagaggtggtcttatgcttgcgccaagcaacttattgagagacttgtctacgctgagggtgctgagaacggacttgagttcaccattgttagaccttttaactggattggacctaggatggatttcatccctggcattgatggtcctagcgagggtgttcctcgtgtcctagcatgctttagcaacaaccttctgcggcgagagcctctcaagcttgtggatggtggagaatcacagagaaccttcatctacatcaaagatgctattgaagctgtccttttgatgattgaaaatccagagagagcaaatgggcatatcttcaatgtaggcaacccaaacaacgaagtgacagtaagacaacttgctgaaatgatgactgaggtctactcaaaagtgagtggagagacggcgattgagagtccaacgatagacgtgagctccaaagaattttatggagaaggttatgatgacagcgacaagagaatcccagacatgaccatcataaaccgtcaacttggatggaacccgaagacgtctctctgggacttgctggagtcgaccttaacttaccagcataggacctatgcggaagctgttaagaaggccacttcaaaaccagtcgcatcttagaggtcatcacctcgaatcatttggtggctaccattccattctttttgctttttttcttcttctaaatttcacccaatattcccttaaaataggctattctaaacgaatgattataatatcatatggtggtttgggtactagttttcgtttgattgtaatagtaattactgataatttcttttgaactcgttaaaatgcttcatatctttgtattttgtccgaaactaaaaaagggaatggtttgttcaaactataacattcatattttacana

SEQ ID NO: 4735 - DNA, 1446 bp, Brassica napus
tcacccattgatttacactttcaccgacaaacgatggcgaacggagccgatcgattggatctggacggcaggccgatcaagccgctgacgatatgcatgatcggcgccggcggcttcatcggctctcacctctgcgagaagctcatgaacgagactccgcacaaggtcctcgccctcgacgtctacaacgacaagatcaagcacttgctcgagcctggtacttctcagtgggcggagaggatccagttccatcgcatcaacatcaagcacgattcgaggctcgagggactcgtcaagatggcggatctgacgattaatttggctgcgatctgtacgccggcggattacaatacgcgtcctcttgacactatctacagcaatttcatcgatgctctccctgtggttaagtactgctctgagaacaacaagcgtttgattcacttctccacttgtgaagtctatggcaaaactattggaagctttcttcccaaggatcatcctctccgtcaggatcctgatttttatgtgctcaaggaagatacatctccttgcatatttggttctattgagaagcagaggtggtcatatgcttgcgccaagcagctgattgagagacttgtctacgctgagggtgctgagaacggacttgagttcaccattgtgagaccgtttaactggattggacctaggatggatttcatccctggcattgatggtcctagcgagggtgtccctcgtgtcttagcatgctttagcaacaaccttcttaggcgcgagcctctcaagcttgtggatggtggagagtcgcagagaaccttcatttacatcaaggatgctattgaagctgtccttttgatgattgaaaacccagagagagccaatgggcatatcttcaatgtaggcaacccaaacaatgaagtgacagtaagacaacttgctgaaatgatgactcaggtgtactcaaaagtgagtggagaggcggctattgagagtccaacggtagacgtgagctccaaagagttttatggagaaggttatgatgacagcgacaagagaatcccagacatgaccatcataaaccgtcaacttggatggaacccgaagacttctctctgggacttgttggagtcgaccttgacttaccagcacaggacctatgcggaagctgttaagaaggccacttcaaaaccagtcgcatcttagaggtcatcatcacctcgaaccatttggtggctactactccattatttttgcttcttcttttataattcacccattatccccttaaaataggccattgtaagcgaatgattataatttcatatggtgtttggtactagttttcgttttttttttgttatatagtatttactgataatgtcttttgaatgcgttgttgagagctttatatctttgtattttgtccgaaactaaaaagggaatggt

SEQ ID NO: 4736 - DNA, 1438 bp, Brassica napus
ttacactttcaccgacaaacgatggcgaacggagccgatcgattggatctggacggcaggccgatcaagccgctgacgatatgcatgatcggcgccggcggcttcatcggctctcacctctgcgagaagctcatgaacgagactccgcacaaggtcctcgccctcgacgtctacaacgacaagatcaagcacttgctcgagcctggtacttctcagtgggcggagaggatccagttccatcgcatcaacatcaagcacgattcgaggctcgagggactcgtcaagatggcggatctgacgattaatttggctgcgatctgtacgccggcggattacaatacgcgtcctcttgacactatctacagcaatttcatcgatgctctccctgtggttaagtactgctctgagaacaacaagcgtttgattcacttctccacttgtgaagtctatggcaaaactattggaagctttcttcccaaggatcatcctctccgtcaggatcctgatttttatgtgctcaaggaagatacatctccttgcatatttggttctattgagaagcagaggtggtcatatgcttgcgccaagcagctgattgagagacttgtctacgctgagggtgctgagaacggacttgagttcaccattgtgagaccgtttaactggattggacctaggatggatttcatccctggcattgatggtcctagcgagggtgtccctcgtgtcttagcatgctttagcaacaaccttcttaggcgcgagcctctcaagcttgtggatggtggagagtcgcagagaaccttcatttacatcaaggatgctattgaagctgtccttttgatgattgaaaacccagagagagccaatgggcatatcttcaatgtaggcaacccaaacaatgaagtgacagtaagacaacttgctgaaatgatgactcaggtgtactcaaaagtgagtggagaggcggctattgagagtccaacggtagacgtgagctccaaagagttttatggagaaggttatgatgacagcgacaagagaatcccagacatgaccatcataaaccgtcaacttggatggaacccgaagacttctctctgggacttgttggagtcgaccttgacttaccagcacaggacctatgcggaagctgttaagaaggccacttcaaaaccagtcgcatcttagaggtcatcatcacctcgaaccatttggtggctactactccattatttttgcttcttcttttataattcacccattatccccttaaaataggccattgtaagcgaatgattataatttcatatggtgtttggtactagttttcgttttttttttgttatatagtatttactgataatgtcttttgaatgcgttgttgagagctttatatctttgtattttgtccgaaactaaaaagggaatggtttgt

SEQ ID NO: 4737 - DNA, 1304 bp, Brassica rapa
aacggagccgatcgattggatctggacggcaggccgatcaagccgctgacgatatgcatgatcggcgccggcggcttcatcggctctcacctctgcgagaagctcatgaacgagactccgcacaaggtcctcgcgctcgacgtgtacaacgacaagatcaagcacttgctcgagccggatacttctcagtgggccgagaggatccagttccatcgcatcaacatcaagcatgattcgagactcgagggactcgtcaagatggcggatctgacgattaatttggctgcgatctgtacgccagcggattacaatacgcgtcctcttgacactatctacagcaatttcatcgatgctctccctgtggttaagtactgctctgagaacaacaagcgtttgattcacttctccacttgtgaagtctatggcaaaactattggatcctttcttcccaaggatcatcctctccgtcaggttcctgatttttatgtacttaaagaagatacatccccttgcatatttggttctattgagaagcagaggtggtcatatgcttgcgccaagcagctgattgagagacttgtctacgctgagggtgctgagaacggacttgagttcactattgtgagaccgtttaactggattggacctaggatggatttcatccctggcattgatggtcctagcgagggtgtccctcgtgtcctagcatgttttagcaacaaccttctgaggcgtgagcctctcaagcttgtggatggtggagaatcacagagaaccttcatctacatcaaagatgctattgaagctgtccttctgatgattgaaaacccagagagagccaatgggcatatcttcaatgtaggcaacccaaacaatgaagtgacagtaagacaacttgctgaaatgatgactcaggtgtactcaaaagtgagtggagagacggctattgagagtccaacggtagacgtgagctccaaagagttttatggagaaggttatgatgacagcgacaagagaatcccagacatgaccatcatcaaccgtcaacttggatggaacccgaagacttctctctgggacttgctagagtcgaccttaacttaccagcacaggacctatgcggaagctgttaagaaggccacttcaaaaccagtcgcatcttagaggtcatcatctcctcgaaccatttggtggctactactccattatttttgcttcttcttttataattcacccattatccccttaaaataggccattgtaagcgaatgattataatttcatatggtgtttggtactagttt

SEQ ID NO: 4738 - DNA, 1447 bp, Cleome gynandra
tcgggtaagcccaaaaaatctctccctctatttctctttcctcctgcttctcctcctcttacagccattgcattatcatcttctagagagagaaagcgcgcggttcttgaggattttgtctccggtcataggaaaggcttgtttggttcttgcgatttcaaaaactttcccgagaaatggagaatggagccggtagagtggatctcgacgggaggtcgataaaaccgatcacgatatgcatgatcggtgccggaggtttcatcggctctcacctctgtgagaagctaatgtcggagacgccgcacaaggtgcttgctctcgacgtctacagcgacaagatcaagcacttgctcgagcctgatacgcttccctgggccgatcggatccagttccatcgtatcaatatcaagcatgattccaggctcgaaggccttatcaagatggcggatctgactataaatctcgctgcgatctgtactccggcagattataatacgcgtccccttgacacaatctacagcaatttcatcgatgcgctcccagtggttaaatactgttcagagaacaacaagcgtctcattcacttttcgacttgtgaagtgtatgggaaaactattggaagctttcttccaaaggatcatcctctgcgtcaggaccctgattactacgttctcaaagaagatacttccccctgcatttttggttctattgagaagcagaggtggtcatatgcctgtgcgaagcaactgattgagagactcatttatgctgagggtgctgagaacggactccagttcacaattgtgagaccatttaactggattggacctagaatggatttcatccccggcattgatggcccaagtgagggtgttcctcgagtcctagcatgctttagtaacaacctcctacgcggtgagcctctcaagcttgtggatggtggacaatcccagagaactttcatctacatcaaggatgctattgaagctgtccttttgatgatcgaaaacccggacagggccaatggccatatcttcaatgtaggcaacccggacaatgaagttacagtgcgtcaacttgctgaaatgatgaccaaggtttactcaaaagtcagtggagaggccgccctggagagtccgacaatagacgtcagctccaaagaattctatggagaagggtatgacgacagtgacaagagaatcccagacatgaccatcataaaccgccaacttggatggaacccgaagacgtctctttgggacctgctcgagtcgaccttaacataccaacacaggacctacgccgaggccgtgaagaaagcagtgtccaaaccaattgcgtcctagtggagattggtaataaagaaaacctcaactacattcccatatcaataatacatacaaaaaagaaaaggaaccattgggcatgcataactaaatgagtcttc

SEQ ID NO: 4739 - DNA, 1620 bp, Gossypium hirsutum
tctcagctcttttcttctcttgtgacactgctaatattttttttattgtcgtctccggcgttcgaagatcataaaaaaccggagtcgtttcaaatggctacgagaacggatctagatgggaggccaataaagccgatgacgatatgcatgatcggtgccggaggcttcatcggctcccacctttgcgagaaattgatgtcggagacgccgcacaaggtgctcgccttggacgtttacaatgacaagatcaagcacctcctcgagcctgactctctcccttgggctggccgtattcagttccaccgacttaacatcaagcacgattctaggctcgaaggcctcatcaagatggcagatctcgtgataaatcttgctgccatctgtactccggcagattataatacgcgtccactagacacgatttacagcaattttattgatgcacttcctgtggtgaagtactgttcagagaacaacaagcgtctcattcacttctctacttgtgaagtgtatggaaaaactattggaagctttcttcctaaagattctcctctccgtcaggatcctgcctactatgttcttaaggaagatacttccccctgcatttttggttcaattgagaagcagaggtggtcctatgcatgtgctaagcagttgattgagaggcttatttatgctgaaggggcagagaatggcctcgagttcactattgtgaggccttttaactggattggacccaggatggatttcattcctggcattgatggtcctagtgagggagttcccagagttcttgcatgctttagtaataatctcctacgtcgtgaaccacttaagcttgtggatggtggcgaatctcagagaacttttatatacataaaggatgctattgaagctgttctcttgatgattgaaaatccagatagggccaatggccatattttcaatgtgggtaacccgaacaatgaagtcacagttaggcaacttgctgaaatgatgactaaggtctatgccaaggttagtggagaaactgtgctggagtctccaacagttgatgtcagctccaaggaattttatggtgagggttatgatgatagtgacaagagaattccagacatgaccataataaacaaacaactcggttggaaccccaagacatccctttgggacttgctcgaatctaccctaacctaccaacacaggacttatgccgaggctattaagaaatctatagcaaaaccttctgcatcctaaaggaggctagatgtttaaaccacggctaagaaaggactcattaaatgtgcttcatggcaaatgtttcaattcttctttcccccccttcttttaggaagtcttaaatatatcataatgttgcttttctttatacccccccccctttttttttgtcttccccgtgttggtagttgatagctcactgtagctctggcagctatgttatcagaatggttttatgtggagacgttcttactagggaatggtattgttttagtattataattattattccagtggagctttgagctgcagcagcatgttgggggcgttaaatattacacaaaaggaaaggaaaaactgtttttatggttttttagatggttc

SEQ ID NO: 4740 - DNA, 1714 bp, Mimulus guttatus
cgcgcaaatactgaaacaaatcacaactattttttaccatctctagctagagagagagagagagaagaagaaacaacaattatctgaggagaagaatttttttgtttttgttggcttcagaaatggcgactggaagagtagatctggacggaaatccgataaagccgatgacgatatgcatgatcggcgccggaggtttcatcggctcgcatctgtgcgagaagctgttgacggagacgccgcacaaggtgctcgccgttgatgtttacaatgacaaaatcaagcacctcctcgagccttccacggcggagtgggccgatcgcatccagttccaccgccttaacatcaaaaacgattctcgcctcgaaggcctcatccgcatggcagatctcaccataaatcttgcggctatatgtaccccagcagattataacacacgccctcttgacacaatttacagcaacttcattgatgctctccctgtggttaaatactgttcggaaaataacaagcgccttatacatttctccacttgtgaagtatacgggaaaacgattggttgctttttacccaaagatagtccattacggcaggaccccgagtactatgttcttaaggaggatacatcaccttgcatttttggcccaattgataagcagaggtggtcatatgcctgtgccaagcagttaattgagagattggtttacgctgagggtgctgagaatggtcttgagttcacaatagtgaggcccttcaactggattggtcccagaatggatttcatccccggaattgatggtccaagcgaaggtgttcctagagttcttgcttgctttagcaataatctcttaaggggtgaaccactgaagcttgttgatggtggcgaatcacaaagaactttcgtttatatcaaggatgccattgaagctgttcttctgatgattgaaaatccagccagggctaatggtcatatatttaacgttggcaaccccgacaatgaagttacagtcaggcagctcgctgaaatgatgactaaggtgtactcaaaggttagcggagaaccttcactagattcacctaccattgatgtaagctcgaaagaattctacggtgaagggtacgatgatagtgacaagagaattccagacatgaccataatcaacagacaacttggatggaaccctaagacgtcgctttgggacttgctggagtcgactcttacttaccaacacaggacgtatgctgaagcagtgaagaaggctacttcacaagctgcagcgaattaaggaaaaaaagaacgatgtttggttttgattcattttcaaggattttttctttccatatatgatgatacggttccttactccgatacgccgcgcacacgtgattcttttgtctctttgagtgtctctatcttagtctcgtacacagctcgctcactactgtaatgattctcctcctcgtgtatgtctgtctaatatctttggaaagttgttataggcagtctattactactagtactacattatatttttgttgtgatgtgctgctgcttaaaacaatattctggatatcgtatgaggataaagaaagtagtatttgctcgtttgaggtttctgtttttagtgatataagatctgttcttagcttttgcttacaagagcatgttgtatcatcttgttcaaactatattagtagttgaattttatttttt

SEQ ID NO: 4741 - DNA, 1741 bp, Mimulus guttatus
attcccaaaattcacgcgcaaatactgaaacaaatcacaactattttttaccatctctagctagagagagagagagagaagaagaaacaacaattatctgaggagaagaatttttttgtttttgttggcttcagaaatggcgactggaagagtagatctggacggaaatccgataaagccgatgacgatatgcatgatcggcgccggaggtttcatcggctcgcatctctgcgagaagctgttgacggagacgccgcacaaggttctcgccgttgatgtttacaatgacaaaatcaagcacctcctcgagccttccacggcggagtgggccgatcgcatccagttccaccgccttaacatcaaaaacgattctcgcctcgaaggcctcatccgcatggcagatctcaccataaatcttgcggctatatgtaccccagcagattataacacacgccctcttgacacaatttacagcaacttcattgatgctctccctgtggttaaatactgttcggaaaataacaagcgccttatacatttctccacttgtgaagtatacgggaaaacgattggttgctttttacccaaagatagtccattacggcaggaccccgagtactatgttcttaaggaggatacatcaccttgcatttttggcccaattgataagcagaggtggtcatatgcctgtgccaagcagttaattgagagattggtttacgctgagggtgctgagaatggtcttgagttcacaatagtgaggcctttcaactggattggtcccagaatggatttcatccccggaattgatggtccaagcgaaggtgttcctagagttcttgcttgctttagcaataatctcttaaggggtgaaccactgaagcttgttgatggtggcgaatcacaaagaactttcgtttatatcaaggatgccattgaagctgttcttctgatgattgaaaatccagccagggctaatggtcatatatttaacgtgggcaaccccgataatgaagttacagtcaggcagcttgccgaaatgatgactaaggtgtactcaaaggttagcggagaaccttcactagattcacctaccattgatgtgagctcgaaagaattctacggcgaagggtacgatgatagtgacaagagaattccagacatgaccataatcaacagacaacttggatggaaccctaaaacgtcgctttgggacttgctggagtcgactcttacttaccaacacaggacgtatgctgaagcagtgaagaaggctacttcacaagctgcagcgaattaaggaaaaaaaaagaacgatgtttggttttgattcattttcaaggattttttctttccatatatgatacggttccttacttcaatacgccgcgcacacgtgattcttttgtctctttgagtgtctctatcttagtctcgtacacagctcactactgtaatgattctcctcctcgtgtatgtctgtctaatatctttggaaagtcgttattaggcagtctattactactagtactacattatatttttgttgtgatgtgctgctgcttaaaacaatattctggataccgtacgaggataaagaaagtagtatttgctcgtttgaggtttctgtttttagtgatataagatctgttcttagcttttgcttacaagagcatgttgtatcatcttgttcaaactatattagtagttgaattttattttttaaataattagttaattg

SEQ ID NO: 4742 - DNA, 1818 bp, Gossypium hirsutum
ctccatctccatttctctcagctcttttcttctcttgtgacactgctaatattttttttattgtcgtctccggcgttcgaagatcataaaaaaccggagtcgtttcaaatggctacgagaacggatctagatgggaggccaataaagccgatgacgatatgcatgatcggtgccggaggcttcatcggctcccacctttgcgagaaattgatgtcggagacgccgcacaaggtgctcgccttggacgtttacaatgacaagatcaagcacctcctcgagcctgactctctcccttgggctggccgtattcagttccaccgacttaacatcaagcacgattctaggctcgaaggcctcatcaagatggcagatctcgtgataaatcttgctgccatctgtactccggcagattataatacgcgtccactagacacgatttacagcaattttattgatgcacttcctgtggtgaagtactgttcagagaacaacaagcgtctcattcacttctctacttgtgaagtgtatggaaaaactattggaagctttcttcctaaagattctcctctccgtcaggatcctgcctactatgttcttaaggaagatacttccccctgcatttttggttcaattgagaagcagaggtggtcctatgcatgtgctaagcagttgattgagaggcttatttatgctgaaggggcagagaatggcctcgagttcactattgtgaggccttttaactggattggacccaggatggatttcattcctggcattgatggtcctagtgagggagttcccagagttcttgcatgctttagtaataatctcctacgtcgtgaaccacttaagcttgtggatggtggcgaatctcagagaacttttatatacataaaggatgctattgaagctgttctcttgatgattgaaaatccagatagggccaatggccatattttcaatgtgggtaacccgaacaatgaagtcacagttaggcaacttgctgaaatgatgactaaggtctatgccaaggttagtggagaaactgtgctggagtctccaacagttgatgtcagctccaaggaattttatggtgagggttatgatgatagtgacaagagaattccagacatgaccataataaacaaacaactcggttggaaccccaagacatccctttgggacttgctcgaatctaccctaacctaccaacacaggacttatgccgaggctattaagaaatccatagcaaaaccttctgcatcctaaaggaggctagatgtttaaaccacggctaagaaaggactcatgaaatgtgctttatggcaaatgtttcaattcttctttcccccccttcttttaggaagtcttaaatatatcataatgttgcttttctttatacccccccctttttttttttgtcttccccgtgttggtagttgatagctcactgtagctctggcagctatgttatcagaatggttttatgtggagacgttcttactagggaatggtattgttttagtattataattattattccagtggagctttgagctgcagcagcatgttgggggcgtcaaatatattacacaaaaggaaaggatatactgtttttatggttttttagatggttctttaatttgtctcacctgagttgttttgttaatttgtttgaacctcttcacttgctcatggtgttattattattttattctttttctcattccctaagcaaatcgaagggaagagactaaactgcctgtttagtcactagtaagaacgtcacggtgttgaagaattaacagcagagtaact

SEQ ID NO: 4743 - DNA, 1628 bp, Gossypium hirsutum
  misc_feature (1572)..(1572): n is a, c, g, or t
  misc_feature (1591)..(1591): n is a, c, g, or t
  misc_feature (1608)..(1608): n is a, c, g, or t
ctccatctccatttctctcagctcatttcttctcttgtaacactgctaatatttttttttatcgtcgtctccgtcgttcgaagattataaaaaaccggcgtcgtttcaaatggctacgagaacggatcttgatgggaggccaataaagccgttgacgatatgcatgatcggcgccggaggcttcatcggctcccacctttgcgagaaattgatgtcggagacgccgcacaaggtgctcgccttggacgtttacaatgacaagatcaagcatctcctcgagcctgactctctcccttgggctggccgtattcagttccaccgacttaacattaagcacgattctaggctcgaaggcctcatcaagatggcagatctcacgataaatcttgctgccatatgtactccggcagattataatacgcgtccactagacacgatttacagcaattttattgatgcacttcctgtggtgaagtactgttcagagaacaacaagcgtctgattcacttctctacttgtgaagtgtatggaaaaactattggaagctttcttcctaaagattctcctctccgtcaggatcctgcctactatgttcttaaggaagatacttccccctgcatttttggttcaattgagaaacagaggtggtcctatgcatgtgctaagcagttgattgagaggctcatttatgctgaaggggcagagactgggctcgagttcactattgtgaggccttttaactggattggacccaggatggatttcattcctggtattgatggtcctagtgagggagttcccagagttcttgcatgctttagtaataatctcctacgtcgtgaaccacttaagcttgtggatggtggcgaatctcagagaacttttatatacataaaggatgctattgaagctgttctcttgatgattgaaaatccagatagggccaatggccatattttcaatgtgggtaacccgaacaatgaagtcacagttaggcaacttgctgaaatgatgactaaggtctatgccaaggttagtggagaaactgtgctggagtctccaacagttgatgtcagctccaaggaattttatggtgagggttatgatgatagtgacaagagaattccagacatgaccataataaacaaacaactcggttggaaccccaagacatccctttgggacttgctcgaatctaccctaacctaccaacacaggacttatgccgaggctattaagaaatccatagcaaaaccttctgcatcctaaaggaggctagatgtttaaaccacggctaagaaaggactcatgaaatgtgctttatggcaaatgtttcaattcttctttcccccgcttcttttaggaagtctttaaatatatcatatatgttgatcttctttataccccccctttttttttttttttttgtcttccccatgttggtagtcaatagctcactgtagctctggcagctatgttattagaatggttttatgtggagacgttcttacaaggggaatggtattgttttagtattataattattattccagtggagctttgagctgcancagcatgttgggggcgtcnaatatattacacaaaangaaaggataaattgttttta

SEQ ID NO: 4744 - DNA, 1629 bp, Solanum lycopersicum
cttgctttaaatacattcaccgtcaaaaacctttacatacatatcgattcacttcaatatagagagagaaactgaaaaaagtatcttaaaaaaaattgtagtgagagaggatttgcagtaatcggaaatggcaggaagagtagatctggacggtaatcccattaagcagattacgatatgcatgattggtgccggtggattcattggttctcatttatgtgagaagcttctgtcggagactcctcataaggtgcttgctgtcgatgtttacagtgataagattaagcatttgcttgaaccggcgacggttacttgggctgatcgaattcagtttcatcgaatcaatattaagaatgattctcgccttgaaggtctcatcaaaatggcagatctgaccataaatcttgctgcgatctgcacacctgcagattacaacactcgtccacttgatacaatttacagcaatttcatcgatgctctaccagtggtcaagtactgctcagaaaatggaaagcgtctcattcacttctcaacttgtgaagtttatgggaaaaccataggtgcctttttaccgaaagacagcccactccggcaggatcctgcttattatgtgcttaaggaagacacctccccttgcatctttggaccaattgagaagcagcggtggtcctatgcatgtgcaaaacagttgattgagaggctggtctatgctgagggtgcggagaatggcttagagttcactattgtaaggccatttaactggattggtcctaggatggattttattcccggcattgatggtcctagtgaaggtgttccaagagtattagcttgctttagtaataaccttttaagacgtgagcctttgaaacttgtggatgggggagaatctcaaaggaccttcatatatatcaaagatgctattgaagctgttcttctaatgatcgaaaatcctgccagagccaatggccatatctttaatgttggtaaccctaacaatgaagttactgtcaggcagctggctgaaatgatgactaaggtgtatgcaaaggtgagtggagagtcttctattgaaacacccaccattgatgtaagttctaaagaattttatggtgaggggtatgatgacagtgacaagaggattccggacatgaccataatcaacaggcagcttggttggaacccaaagacttccctatgggacttgctagaatccacactcacataccaacacaggacatacgccgaggctgtcaagcaggccatgtctaaaacaacagcaaattgattgttcgctgcttgttggcaggtctttcaatatcttgttacgattctcctgagtaaaaatctacatagtccttcacctcatacacgtaattttacgtcccttctgtaatcaatcatgtattctattttgtgacagcatatttattaagaaatttgtgtcataggctgggtgtattatgtcactagagcttcaaaatagttatcggggtattagataaaggaaaagctgtcctgttcttataagatctgttgtcgtctatatatttattcctatgtatggaaacatcttgtatcattttgatcgacctgttgatggggctataaattttcctatttattcat

SEQ ID NO: 4745 - DNA, 1680 bp, Solanum lycopersicum
cttgctttaaatacattcaccgtcaaaaacctttacatacatatcgattcacttcaatatagagagagaaactgaaaaaagtatcttaaaaaaaattgcagtgagagaggatttgcagtaattggaaatggcaggaagagtagatctggacggtaatcccattaagcagattacgatatgcatgattggtgccggtggattcattggttctcatttatgtgagaagcttctgtcggagactcctcataaggtgcttgctgtcgatgtttacagtgataagattaagcatttgcttgaaccggcgacggttacttgggctgatcgaattcagtttcatcgaatcaatattaagaatgattctcgccttgaaggtctcatcaaaatggcagatctgaccataaatcttgctgcgatctgcacacctgcagattacaacactcgtccacttgatacaatttacagcaatttcatcgatgctctaccagtggtcaagtactgctcagaaaatggaaagcgtctcattcacttctcaacttgtgaagtttatgggaaaaccataggtgcctttttaccgaaagacagcccactccggcaggatcctgcttattatgtgcttaaggaagacacctccccttgcatctttggaccaattgagaagcagcggtggtcctatgcatgtgcaaaacagttgattgagaggctggtctatgctgagggtgcggagaatggcttagagttcactattgtaaggccatttaactggattggtcctaggatggattttattcccggcattgatggtcctagtgaaggtgttccaagagtgttagcttgctttagtaataaccttttaagacgtgagcctttgaaacttgtggatgggggagaatctcaaaggaccttcatatatatcaaagatgctattgaagctgttcttctaatgatcgaaaatcctgccagagccaatggccatatctttaatgttggtaaccctaacaatgaagttactgtcaggcagctggctgaaatgatgactaaggtgtatgctaaggtgagtggagagtcttctattgaaacacccaccattgatgtaagttctaaagaattttatggtgaggggtatgatgacagtgacaagaggattccggacatgaccataatcaacaggcagcttggttggaacccaaagacttccttatgggacttgctagaatccacactcacataccaacacaggacatacgctgaggctgtcaagcaggccatgtctaaaacaacagcaaattgattgttcgctgcttgttggcaggtctttcaatatcttgttacgattctcctgagtaaaaatctacatagtccttcacctcatacacgtaattttacgtcccttctgtaatgaatcatgtattctattttgtgacagcatatttattaagaaatttgaaaacctttttaacaatacaatgctaaggatactagatggacaggaatgcaggtgtcataggctgggtgtattatgtcactagtgcttcaaaatagttatcggggtattagataaaagaaaagctgtcctgttcttataagatctgttgtcgtctatatatttattcctatgtatggaaacatcttgtatcattttcatcgacctgttgatggggctataaattttcctatttattc

SEQ ID NO: 4746 - DNA, 1574 bp, Solanum tuberosum
caatatagagagagaaattgaaaaaatatctttaaaaaattgtagtgagagaggattagcagtaatcggaaatggcaggaagagtagatctggacggtaatcccataaaacagattacgatatgcatgattggtgccggtggattcattggttctcatttatgtgagaagcttttgtcggagactcctcataaggtgctagccgtcgatgtttacagtgataagattaagcatttgcttgaaccggcgacggttacttgggctgatcgaattcagtttcatagaatcaatattaagaatgattctcgccttgaaggtctcatcaaaatggcagatctgaccataaatcttgctgcgatctgtactccagcagattataacactcgtccacttgatacaatttacagcaatttcattgatgctctaccagtggtcaagtactgctcagaaaatggaaagcgtctcattcacttctcaacttgtgaagtttacgggaaaaccataggtgcctttttacccaaagacagcccactgcggcaggatcctgcttattatgtgcttaaggaagacacctccccttgcatctttggaccaattgagaagcagcggtggtcctatgcgtgtgcaaaacaattgattgagaggctggtctatgctgagggtgcggagaatggcttagagttcactattgtaaggccatttaactggattggtcctaggatggatttcattcctggcatcgatggtcctagtgaaggtgttccaagagtattagcttgctttagtaataaccttttaagacgtgaacctttgaaacttgtggatgggggagaatcacaaaggacgttcatatacatcaaagatgctattgaagctgttcttctaatgatcgaaaatcctgccagagccaatggccatatctttaatgttggtaaccctaacaatgaagttactgtcaggcagctggctgaaatgatgactaaggtgtactcaaaggtgagtggagagtcttctattgaaacacccaccattgatgtaagttctaaagaattttatggtgaggggtatgatgacagtgacaagaggattccggacatgaccataatcaacaggcagcttggttggaacccaaagacttccctatgggacttgctagaatccacactcacataccaacacaggacctacgccgaggctgtcaagcaggccatgtctaaaacaacagcaaattgattgttcgctgcttgttggcaggtctttcaatatcttgttacgattctcccgagtaaaaatctacagtccatcactcatacacgtaattttacgtcccttctgtaatcaatcatgtattctattttgtgacagcatatttattaagaaatttgtgtcataggctgggtgtattatgtcactagagcttcaaatagttattggggtattagataaaggaaaagctgtcctgttcttgtaagatttgttgtcattcatctattcattcctgtgtatggaaacatcttgtatcattaagatcgacctattgatggagctataaattttcctatttattcaaaaaaa

SEQ ID NO: 4747 - DNA, 1584 bp, Solanum tuberosum
ggattcacttcaatatagagagagaaattgaaaaaatatctttaaaaaattgtagtgagagaggattagcagtaatcggaaatggcaggaagagtagatctggacggtaatcccataaaacagattacgatatgcatgattggtgccggtggattcattggttctcatttatgtgagaagcttttgtcggagactcctcataaggtgctagccgtcgatgtttacagtgataagattaagcatttgcttgaaccggcgacggttacttgggctgatcgaattcagtttcatagaatcaatattaagaatgattctcgccttgaaggtctcatcaaaatggcagatctgaccataaatcttgctgcgatctgtactccagcagattataacactcgtccacttgatacaatttacagcaatttcattgatgctctaccagtggtcaagtactgctcagaaaatggaaagcgtctcattcacttctcaacttgtgaagtttacgggaaaaccataggtgcctttttacccaaagacagcccactgcggcaggatcctgcttattatgtgcttaaggaagacacctccccttgcatctttggaccaattgagaagcagcggtggtcctatgcgtgtgcaaaacaattgattgagaggctggtctatgctgagggtgcggagaatggcttagagttcactattgtaaggccatttaactggattggtcctaggatggatttcattcctggcatcgatggtcctagtgaaggtgttccaagagtattagcttgctttagtaataaccttttaagacgtgaacctttgaaacttgtggatgggggagaatcacaaaggacgttcatatacatcaaagatgctattgaagctgttcttctaatgatcgaaaatcctgccagagccaatggccatatctttaatgttggtaaccctaacaatgaagttactgtcaggcagctggctgaaatgatgactaaggtgtactcaaaggtgagtggagagtcttctattgaaacacccaccattgatgtaagttctaaagaattttatggtgaggggtatgatgacagtgacaagaggattccggacatgaccataatcaacaggcagcttggttggaacccaaagacttccctatgggacttgctagaatccacactcacataccaacacaggacctacgccgaggctgtcaagcaggccatgtctaaaacaacagcaaattgattgttcgctacttgttggcaggtctttcaatatcttgttacgattctcccgagtaaaaatctacagtccatcactcatacacgtaattttacgtcccttctgtaatcaatcatgtattctattttgtgacagcatatttattaagaaatttgtgtcataggctgggtgtattatgtcactagagcttcaaatagttattggggtattagataaaggaaaagctgtcctgttcttgtaagatttgttgtcattcatctattcattcctgtgtatggaaacatcttgtatcattaagatcgacctattgatggagctataaattttcctatttattcaaaaaaa

SEQ ID NO: 4748 - DNA, 1624 bp, Solanum phureja
cttgctttaaatatattcaccgtcaaaaaacctatacatacatattgattcacttcaatatagagagagaaatttaaaaaatatcttcaaaaaattgcggtgagagaggatttgcagtaatcggaaatggcaggaagagtagatctggacagtaatcccataaaacagattacgatatgcatgattggtgccggtggattcattggctctcatttatgtgagaagcttttgtcggagactcctcataaggtgctcgccgtcgatgtttacagtgataagattaagcatttgcttgaaccggcgacggttacttgggctgatcgaattcagtttcatcgaatcaatattaagaatgattctcgccttgaaggtctcatcaaaatggcagatctgaccataaatcttgctgcgatctgtactccagcagattataacactcgtccacttgatacaatttacagcaatttcattgatgctctaccagtggtcaagtactgctcagaaaatggaaagcgtctcattcacttctcaacttgtgaagtttacgggaaaaccataggtgcctttttacccaaagacagcccactgcggcaggatcctgcttattatgtgcttaaggaagacacctccccttgcatctttggaccaattgagaagcagcggtggtcctatgcgtgtgcaaaacaattgattgagaggctggtctatgctgagggtgcggagaatggcttagagttcactattgtaaggccatttaactggattggtcctaggatggatttcattcctggcatcgatggtcctagtgaaggtgttccaagagtattagcttgctttagtaataaccttttaagacgtgaacctttgaaacttgtggatgggggagaatcacaaaggacgttcatatacatcaaagatgccattgaggctgttcttctaatgatcgaaaatcctgccagagccaatggccatatctttaatgttggtaaccctaacaatgaagttactgtcaggcagctggctgaaatgatgactaaggtgtactcaaaggtgagtggagagtcttctattgaaatacccaccattgatgtaagttctaaagaattttatggtgaggggtatgatgacagtgacaagaggattccggacatgaccataatcaacaggcaacttggttggaacccaaagacttccctatgggacttgctagaatccacactcacataccaacacaggacctacgccgaggctgtcaagcaggccatgtctaaaacaacagcaaattgattgttcgctgcttgttggcaggtcttgcaatatcttgttacgattctcccgagtaaaaatctacagtccatcactcatacacgtaattttacgtcccttctgtaatcaatcatgtattctattttgtgacagcatatttattaagaaatttgtgtcataggctgggtgtattatgtcactagagcttcaaaatagttattggggtattagataaaggaaaagctgtcctgttcttataagatttgttgtcattcatctattcattcctgtgtatggaaacatcttgtatcattttgatcgacctattgatggagcaataaattttcctatttattca

SEQ ID NO: 4749 - DNA, 1878 bp, Citrus sinensis
ttcactagtgattagcgtggtcgcggccgaggtctcgtctctgtctgtctctctctctctctctaccctacatacccggtgcacgttagtatccacctcgccaaagacaacgcattttcaattcgcgtggaacgaaacaaagcaaaatctcaagttcagttttacttctggaaacggaaatggcaggcgcaagcgtgagattggatctggacgggaggccgataaagccgatgacgatatgcatgatcggcgccggcggcttcatcggctctcatctctgcgaaaagattctccttgagacccctcacaaaattctagcactcgacgtctacaatgacaagatcaagcacttgctcgaaccggagtcacagactggggccgaccggatccagttccaccgactcaacatcaagcacgattctcgcctcgaaggcctcatcaagatggcagatctgacgataaatctggcggcgatctgtacgccggcggattacaacacgcggccgttggacacgatctacagcaactttattgacgcgcttccggtggtcaagtactgttcggagaacaacaagcgtttgattcacttctctacttgtgaagtatatggaaagaccattggaagctttcttcctaaagatagtcctcttcggcaggatcctgcttactatgttcttaaagaagatgcctccccctgcatttttggctctattgagaagcagaggtggtcgtatgcatgtgcaaagcaattgattgaaaggctgatttatgctgagggtgcagagaatggtcttgagttcaccattgtgaggccctttaactggattggtccgaggatggacttcattcccggcattgatggtccaagtgagggtgttccaagggttctggcatgctttagtaacaatctccttcgccggcagccactcaagcttgtcgacggtggccaatctcagaggacttttatttacataaaggatgctattgaagctgttctattaatgattgaaaatccagcaagggccaatggtcatattttcaatgtgggcaacccccacaatgaagttacagttcgacagcttgctgagatgatgactgaggtgtatgcaaaggtgagtggagaggctgctttggaggagccaacagttgatgtcagctccaaagaattttatggtgaaggatatgatgatagtgacaagagaattccagacatgaccattataaatcaacagcttggttggaacccgaagacatcactttgggacttgcttgaatcaacccttacctatcagcacaggacatatgcggaggccataaagcaggccgtggcaaaaccagttgcatccagctgaggagatatagtgttcggatgcttgtggcaaacatttaaattctttttcgagttagtcttgaatatatctgaacggttgtttcgaatatactctacattttttttttctctcctccagtgttggtagtcaatatatagctcgctgtagctcaggaagctctcttcagtgttttggatatctactttgagaagcgttagattctactagggaactataaaatcagttaccatcatgttactgtaatttgttgccagagcttgggctacccgcatgctggggtgggggcagtatacaaggaaaaggtgtttttgattcgcttggcggttggcctggcttttctctaaatctttggtctctctcctggggtgtgttgtattaatttgtttgatcctctcaggctcatgttttatttttgattatttattaattctatgcatgtaagatttgttgtttattctgaaattatcaactcttaagagcatataaaattcttcaaccggtaaatgatgaaagagttttacgatta

SEQ ID NO: 4750 - DNA, 1658 bp, Gossypium hirsutum
aagacattctctcccatttctcaccatctccaattagcttctctctcttcctttgtcacgttcggcattcaaaaataacgaaacaccggcgttgtttcaaatggcgactagaatggatctggatggaaggcctataaagccgatgacgatatgcatgattggagccggcggcttcattggttctcacctttgtgagaaactgatggcggagacgccgcacaaggtgcttgccttggatgtttacagtgacaagatcaagcaccttcttgagcctgactctcttccttgggctggccgtattgtgttccaccgacttaacatcaagcacgattctaggctcgaaggccttatcaagatggcagatctcacgataaatcttgcggcgatctgtactccagcagactataatactcgtccacttgacacgatttacagcaattttattgatgcacttccggtggtaaagtactgctcagagaacaacaagcgtcttattcacttctctacttgcgaagtgtatggcaaaacaattggaagctttcttcctaaagattctcctctccggaaggatcctgcctactatgtccttaaggaagatacctccccctgcatttttggttcaatcgaaaagcaaaggtggtcatatgcatgtgctaagcaattgattgagaggcttatttatgctgagggggcagagaatggccttgatttcaccattgtgagaccttttaactggattggacctaggatggatttcatccctggtattgatggtccaagtgagagtgttccaagagttctggcatgctttagtaataatctcttacgccgtgagccactaaagcttgtggatggtggtgaatctcagagaacttttgtttacattaaggatgctattgaagctgttctcttgatgattgaaaatcccgacagggccaatggtcatattttcaatgtcggcaacccaaataatgaagtcacagtgaggcaacttgctgaaatgatgactaaggtctatgcaaaggtaagtggagaaccttcactggagtcaccaacaattgatgtcagttccaaggaattttacggggagggatatgatgatagtgacaagagaattccagacatgaccataataaatagacaacttggttggaaccccaagacaacgctttgggacttgcttgaatcgacccttacctaccaacacaggacttatgctgaggctatcaagaaatccatggtaaaacctattgcatcctaaataggtaaagatgttcagaccatgcctaaggaaggatgcatgtaaaatttacttgttcgaaaaatgttccaattcttttttttccttttaaggagtcctatatatatctgaattgttgattttacttgtatgctacattttgggtcatcccttgtgtcaatagttaatagctcacattagctcaggcagttatgttccctttgtggtcctatgtgtacattattaaatttcttactgatctgaaccgatattgtgttcgtattatatatgttttgagttttgagctacagcatggagtatataaattatactaggaaaggaaagggaagctgtgatttgtttcttacggtctctcttggcctgagctgtgttgtacttataaaatttgtttgaacca

SEQ ID NO: 4751 - DNA, 1737 bp, Cajanus cajan
gattgtattgaaggtatttaacttcaaccaagattattattcacttcgatgtgtttagggttgttcatagattgaaaacgtattgacaaccatagtaaaactccagggacatgaaatgatttatacaagactagggtcacacaacgcacaacagaacagtgtcaggcacagcagcgctcactgattctgcgtaatggcttcgggccgagtagatctggacggaaggcccataaagcccatgaccatttgcatgatcggcgccggtgggttcatcggctcccacctctgcgaaaaactaatgtcggagacccctcacacggttctcgccttggatgtctacagcgacaaaatcaaacacctcttggagccccacacgcttccttgggccggtcgcatccagttccaccgcctcaacatcaagcacgattcgcgcctcgagggcctcatcaagatcgcagatctgaccattaatctcgctgctatttgcacccccgcggattacaacacgcgccccttggacaccatttacagcaacttcatcgacgcgcttcccgtcgtgaagtactgttcggaaaacaacaagcgtctcattcatttctctacgtgtgaagtgtatgggaaaacggttgggagctttctccccaaagatagccctcttcgtaaggatcctgcatactatgtgcttaaggaggatgagtctccttgtatttttggttcaattgagaagcagaggtggtcgtatgcctgtgctaagcagttgattgagaggctgatttatgctgagggtgctgaaaatggcttggaattcacaattgtgagaccttttaattggattggaccaaggatggatttcattcctggcgttgatgggccaagtgagggtgttccccgtgttctggcctgctttagcaataatctcctccgtggagagcccctcaagcttgtggatggtggccaatcccagaggactttcgtgtatattaaggatgctattgaagctgtcttattgatgattgaaaatcctgcaagggccaatgggcatatttttaatgtgggtaacccaaacaatgaggttacagttaggcagcttgctgaaatgatgactcaggtttattcaaaggtaagcggagaagcatctctagaaaaacccactattgatgtgagctccaaagaattttatggtgagggatatgatgatagtgacaagagaattcctgacatgaccataattaataggcagcttggctggaatcctaagacctcactttgggacctgcttgagtccactctcacctatcagcacaggacttatgctgaagccattaagaaagtcattgcaaagccagtggcaagttaaacttaatggtgatgtactgcattgagaagagtgttcagcccataggggcacttacgtatagtttactggttgattttatttatatacatggtaattttccccttggttttgggtttggtagctaaggtagcccatgccttctttattgcatatttatgaggaagtaggaatttagcaaggacaatctgtgctactgccttgtaattttcatgcagagtttcgggcataatttatacgatgaaagaagcatttttgtgttgtatggaatagtgatatctcaggcattcatgtgatgtctttccatattcagctgtaacatttatcatgtttcctaaattaatggtcattaatttatttaataggaaaaaaaaaaaaaaaaa

SEQ ID NO: 4752 - DNA, 1735 bp, Actinidia deliciosa
cgacgacgccacaatctaatctggagagagagacgcacagaaaagtgatagatttcgagagagagagagagagagaggcgcacgcatttcgagagagagagagagagagaggcgcacgcatttcgagagagagagagaggatagttgtagagagagagagaatggcgtcgacagcgagggtagatctggacggaaatccgatcaaggcgatgacgatatgcatgataggggcgggtggtttcatagggtcgcacctgtgcgagaagcttatggcggagacgccccacaaggtgttggcggtagacgtctataatgacaagatcaagcatcttctcgaaccgtcctccctcccctgggccgatcgtattcaattccaccgcatcaacatcaagaacgattcgcggctcgaaggcctcatcaagatggcagatctgactataaatttagcggcgatctgtactccggcggattacaatacgcgtcctcttgatacaatctacagcaatttcatcgatgccctccctgtggtcaagtactgttcagagaacaacaagcgtcttattcacttctctacttgtgaagtctatgggaaaacaattggtagctttcttcctaaagatcaccctctgcggcaggatcctgcttattttgttcttaaagaagatgagtccccctgcattttcggctctattgagaagcagaggtggtcctatgcttgcgcaaagcaattgattgagaggctgatctatgctgagggtgcggagaacggtcttgaattcactattgtgagaccttttaactggattggtcctaggatggacttcatacccggcatcgatggtcccagcgagggtgttccaagagttctggcatgctttagcaataatcttcttagacgagagccactcaagcttgtggatggtggtgaatcacagagaaccttcatttacataaaggatgctattgaggctgttctgctgatgattgaaaatccagccagggctaacgatcatatattcaatgtgggcaatcctaacaatgaagtcacagttaggcaactggctgaaatgatgaccgaggtttactcgaaggtgagtggagaaccttctctagaagtaccgaccgtttatataagctccaaagagttctatggtgaagggtacgatgacagtgacaagaggattcctgacatgacaataatcaataaacaacttggttgggatcccaagacatctctttgggacttgcttgaatcaacccttacgtatcaacacaggacatatgccgaggccgtaaaacaggccatttcaaaaccacttactactagctaagggaggttcgtttctttcccgcgtttgggatcagcttgttgacgctctgtttcaatttatttctaaggaggttatcaaatatattacaagatggttctcatatacgctacatttttcctactttccttagttcacaggtggctcagaattttctttcttttatctatttggagaagaaagtgaactctctttggggaagtttttcataatgtttatgatgtgttaggggatctctggtattttggctacaacacggggattgatactagaaaagcctgttctgttctcgaaggatttgtttcatttctctattttgcttctcctttaaaggagtgttgtattatttatttgaccgatttgggacactgtttttatttaagtcattatttattatttaaaaaaaa

SEQ ID NO: 4753 - DNA, 1652 bp, Vitis vinifera
cgtgtacattgcctgagagcctcatctctttccagtcttcacacctttcaaatataaaacccttcattcccacccaaaaatctacgctcaacctcacctcttctactcttctccccggcgcacgttagccacaatcccttctctagagagagttggcataattgtagagggagaatggcgtcagcggcgaggctagatctggacggaaacgccatcaagccgatgacgatttgtatgatcggcgccggaggattcataggatcgcacctctgcgagaagcttatggccgagacgatgcataaggtcttggccgttgacgtctacagtgacaagatcaagcaccttctcgagccgtctacgcatccttggtccgatcgcattcagtttcaccgcatcaacatcaagcacgattcgaggctcgaaggactcatcaagatggcagatctgactatcaatctggcggcgatctgtactcccgcggactacaatactcgtcctctcgatacgatttacagcaatttcattgatgcccttccagtggtgaaatactgttcggagaacaacaagcgtctcattcacttctcgacttgtgaagtctatgggaaaacgattgggagctttcttcccaaagattcacccctctggcaggatcccacttactatgtcctcaaagaagatgcctccccctgcatttttggtccgattgagaagcagaggtggtcctatgcctgtgcaaagcaattgattgagaggttgatttatgctgagggtgccgagaatgacctagagttcaccattgtgaggccctttaactggattgggcccagaatggattttattcctggcattgatggtcctagcgagggcgttccaagggttctggcatgcttcagtaataaccttcttcgtcatgagccactcaagcttgtggatggtggccaatcccagagaacctttgtttacataaaggatgctattgaagcagtcttgttgatgattgataatcctgccagggctaatggtcacatcttcaatgtgggcaaccccaacaatgaggttactgttaggcagcttgcagaaatgatgactgaggtttatgcaaaggtaagtggggaaccttctttggaggtaccaactgtggatgtaagctccaaagaattctatggtgagggatatgatgacagtgacaagagaattccagacatgaccataatcaataaacaacttggttggaaccctaagacatcgctctgggatttgcttgagtcaaccctcacctatcaacacaggacatatgctgaggctattaagcaggccattgcgaaaccagttgcatcttgagaagggaattctcacttgggggtgtggttggtcagcaaggtgtccaattctttgtaaggaagcattcgatgtgtctaaatgattgattttcatatacgctacaattttctcttttatttttttgggtcatttcagggtcgatagtcaatagtgctcccagttgcaggaatgtgggcatctagtatctattttgagaaagtagactttattaggaaattattcattatgtcactgtatgttgtcagtagctgggctacgagttacgacacattggggaaattatacaaggaaagcctgttttctgtttctca

SEQ ID NO: 4754 - DNA, 1620 bp, Lotus japonicus
accaccatcttcttcttcttcttcttctctgcattgttgttcttgccatggctgcgcgtgtggatctcgatggcaaccccatcaagccattgaccatttgcatgatcggcgccggaggcttcatcggatcccacctctgcgagaagctcatgtcggagacgccgcacaaggtgctcgctctcgatgtctacagtgacaagatcaagcacctcttggagcctgacacgctcccttgggctggtcgcatccacttccatcgcctcaacatcaagcacgattctaggcttgaaggtctcatcaagatgtcagatctgactattaatctcgctgcaatatgcactcctgctgattacaacactcgtcctttggacaccatttacagcaatttcattgatgctcttcctgtggcgaagtactgttcggaaaacaacaagcgtctcattcatttttctacttgtgaagtgtatgggaaaacaattggaagctttcttcctaaggatagcccacttcgtcaggatcctgcatattatgttcttaaagaagatgagtccccttgcatttttggttcaattgaaaagcagagatggtcctatgcttgtgcaaagcagttgattgagaggctgatttacgctgagggtgctgaaaatggcatggagttcacaattgtgagaccttttaattggatcggaccaagaatggatttcattcctggcattgatggtccaagtgagggtgttcccagggttcttgcatgctttagcaataacctcctccgccgagagcccctcaagcttgtggatggtggcgaatcccagaggactttcatttatattaaggacgctattgaagctgtcttattgatgattgaaaatcctgccagggcaaatgggcacatttttaatgtgggtaacccacacaatgaggttacagttaggcagcttgctgaaatgatgactaaggtttattcaaaggtaagtgaagaagctcctttggaaaatcctgcaatagatgtgagctccaaagaattttatggtgaggggtatgacgatagtgacaagagaattcctgacatgaccataattaacaagcaacttggctggaatcctaagacctcactttgggaccttcttgaatctactctaacttatcagcataggacttatgctgaagccattaagaaggcaatagcaaaaccagttgcaagctaagcttacatggtgatgttaatggagtgtttggcccatgggggcactgaaatatagtttacttgttgattttacataaatggtaattgtcccagttggttttggcagccaatagcccacgcccacgtctcttttttattacatgtttatggagaaatagtaatttatcaagggcaatcttgtgcttttgctatgtaattttcatgcaaagcttcttgctatacatgtttagagacccttgtaatgtttagagacccttctacaaggaaagatatttttttgtatggtagggatgtgtcggtcattccttcagttgtaacatttgccatatgtttcctacataatttgtcattgatttattttatggattattttttgtatcaaatgttttcctctagtaatttgtacaagttcc

SEQ ID NO: 4755 - DNA, 1724 bp, Vitis vinifera
cactcaagtctcatcctcacctcttctactcttctccacccggcgcacgttggcccccaatccctactctagagagtaggcataattgtagagaaagaatggcttcggcggcgaggctagatctggacggaaacgccatcaagccgatgacgatttgcatgatcggcgccggaggattcatcggatcgcacctctgtgagaagctcatggctgagacgatgcacaaggtcttggccgttgatgtctacaatgacaagatcaggcaccttctcgagccggctgcacatccttggtccgatcgcattcagtttcaccgcatcaacatcaagcacgattcgaggctcgaaggactcatcaagatggcagatctgactgtcaatctggctgcgatctgtactcccgcagactacaatactcgtcctctcgatacgatttacagcaatttcattgatgcacttccagtggtgaaatactgttcagaaaacaacaagcgtctcattcacttctcgacttgtgaagtctatgggaaaacgattgggagctttcttcccaaagattcacctctccggcaggatccagcttactatcttctcaaagaagatgcctccccctgcatttttggttcaattgagaagcagagatggtcctatgcctgtgcaaagcaattaattgagaggttgatttatgctgaaggtgcagagaatggcctagagttcaccattgtgaggccttttaactggattgggcctagaatggatttcattcctggcattgatggtcctagtgaaggtgttccaagggttctggcatgcttcagcaataaccttcttcgtcgtgagccactcaagcttgtggatggtggccaatcccagagaacctttgtttatataaaggatgctattgaagcagtcttgttgatgattgataatcctggcagggctaatggtcacatcttcaatgtgggcaacccaaacaatgaagctacagttaagcagcttgcagaaatgatgactgaggtttatgcaaaggtgagtggggaaccttctttggaggtaccaactgttgatgtaagctccaaagaattctatggtgaaggatatgatgacagtgacaagagaattccagacatgaccataatcaataaacaacttggttggaaccctaagacatcactctgggatttgcttgagtcaaccctcacctatcagcacaggacatatgctgaggctattaagcaggccattgcgaagccagttgcatcttaagaagcgagttctcacttggggggtgtggttggtctgcaaggtgtccaatactttctgaggaagcattcaaatatatataaatggttgattttcatataagctacatatttttttttttctcttttttttttttaatcatttcagagtctgtagtcaatagtgctcctagtctatttgagaaagtagacttttattaggaaattatcattaggttactgtagttcgtcggtagctgggcttaagacacattggggaaattacacaaggaaagcctattttctgtttcccaaatcccaaggggtttccttagtcatgtctccattttgtctctccaagggtgtgctgtattttttattttgttcgaccaggcacttgttttttttttttcctctttttttcccctaaataattatttgttaattattattttttaaataataatttattaatttctgtcta

SEQ ID NO: 4756 - DNA, 1904 bp, Populus trichocarpa
aaattccctccttcccatataaaccacaccccttccctttcgtcttccgaaaaacacactcatttcacctcctctgaactccctctctctctctctctgatttttagcaatggcatcatcagtggtgagggttgatcttgatggaaaaccaataaatccgctaacaatttgcatgatcggtgctggtggtttcattgggtcccacctgtgtgagaagatcttgaacgagactcaacacaagatcttagcccttgatgtttacaatgacaagatcaagcaccttctcgaaccggacagcctcccttgggctggccggatccagttccaccgtatcaatatcaaacacgactctcgcctcgaaggcctcatcaagatgtcagatctgacgataaatctggctgcgatctgtactccggcggattataatacgcgtcctttggatacgatttatagcaactttatcgacgcgttgcctgtggcgaagtactgttcagagaatgggaagcgtctgattcacttctcgacttgtgaagtgtatgggaaaactattgggagttttcttcctaaagacagtcctcttcgtcaggatcctgcatattatgtgcttaaagaagatgcctctccctgcatttttggttccattgagaagcagagatggtcttatgcgtgtgcaaagcaattgattgagaggctggtttatgctgagggtgcagagaatggacttgagttcaccatcgtgaggcctttcaactggattggacccagaatggattttattcccggtgttgatggcccaagtgagggcgttccccgggttcttgcttgctttagcaatgctcttcttcgccgggagccgctcaagcttgtggatggtggcgaatcccagagaacatttgtttatattaaggatgccatcgaggctgttctcttgatgattgaaaatccttccagggccaatggtcatatttttaacgttggcaaccctaacaatgaagtcactgtgaggcagcttgctgaaatgatgacagcggtctacgcaaatgtaagtggagaacctgctctggaggaaccgacagttgatgtcagctccaaagagttctacggtgagggatatgacgatagtgacaagagaattccagacatgaccataatcaatagacaacttggttggaaccccaagacgtctctgtgggacttgctcgattcaaccctcacttatcaacacaagacttatgccgaggcaatcaagaaggtcatgtcacaacccacaaccagctgaagaaataaatgagacacgatgaaggggatattcctggatgggctggtaattagcgaagtgttccaattctttttaaggcaatcttaagtatatcataatggttggttcgatatacattacaatttttgtctttctggtgtcggtagtcggtggctcagtgtagctcaggaatttgttttaaaaatgtcaaacctcgagaagattctgatgggcaattatgcccgtgtcattgtaatttgtcactttgagcatggtctagggaagtgttgtattaatttgttgacccgatcaagcttatgtttcttaaattattatttattaattcaatcttgtaagcttctttaccttcttgtttgcaaaatcctgacctgtcagagctttgcgtctgtagaatgattcgatgacatgcttattttcgatgcaaatatcttgttgaataaaagagagagaaagaaagaaaatggattcatggaagctgcccacaactctagacatggatatgtctgcgcaaaatatcttgttgacaggagagagcgcatgtggtgttgtagaagatgagcaaactagtaaagaagcttccatccgaatcatgtttccctctgtttctttacatgagatgggatgt

SEQ ID NO: 4757 - DNA, 1754 bp, Populus trichocarpa
aaattccctccttccatataaaccacaccccttccctttcgtcttccgaaaaacacactcatttcacctcctctgaactccctctctctctctctctctgatttttagcaatggcatcatcagtggtgagggttgatcttgatggaaaaccaataaatccgctaacaatttgcatgatcggtgctggtggtttcattgggtcccacctgtgtgagaagatcttgaacgagactcaacacaagatcttagcccttgatgtttacaatgacaagatcaagcaccttctcgaaccggacagcctcccttgggctggccggatccagttccaccgtatcaatatcaaacacgactctcgcctcgaaggcctcatcaagatgtcagatctgacgataaatctggctgcgatctgtactccggcggattataatacgcgtcctttggatacgatttatagcaactttatcgacgcgttgcctgtggcgaagtactgttcagagaatgggaagcgtctgattcacttctcgacttgtgaagtgtatgggaaaactattgggagttttcttcctaaagacagtcctcttcgtcaggatcctgcatattatgtgcttaaagaagatgcctctccctgcatttttggttccattgagaagcagagatggtcttatgcgtgtgcaaagcaattgattgagaggctggtttatgctgagggtgcagagaatggacttgagttcaccatcgtgaggcctttcaactggattggacccagaatggattttattcccggtgttgatggcccaagtgagggcgttccccgggttcttgcttgctttagcaatgctcttcttcgccgggagccgctcaagcttgtggatggtggcgaatcccagagaacatttgtttatattaaggatgccatcgaggctgttctcttgatgattgaaaatccttccagggccaatggtcatatttttaacgttggcaaccctaacaatgaagtcactgtgaggcagcttgctgaaatgatgacagcggtctacgcaaatgtaagtggagaacctgctctggaggaaccgacagttgatgtcagctccaaagagttctacggtgagggatatgacgatagtgacaagagaattccagacatgaccataatcaatagacaacttggttggaaccccaagacgtctctgtgggacttgctcgattcaaccctcacttatcaacacaagacttatgccgaggcaatcaagaaggtcatgtcacaacccacaaccagctgaagaaataaatgagacacgatgaaggggatattcctggatgggctggtaattagcgaagtgttccaattctttttaaggcaatcttaagtatatcataatggttggttcgatatacattacaatttttgtctttctggtgtcggtagtcggtggctcagtgtagctcaggaatgtgttttaaaaatgtcaaacctcgagaagattctgatgggcaattatgcccgtgtcattgtaatttgtcactttgagcatggtctagggaagtgttgtattaatttgttgacccgatcaagcttatgtttcttaaattattatttattaattcaatcttgtaagcttctttaccttcttgtttgcaaaatcctgacctgtcagagctttgcgtctgtagaatgattcgatgacatgcttattttcgatgcaaatatcttgttgaataaaagagagagaaagaaagaaaatggattcatggaa

SEQ ID NO: 4758 - DNA, 1592 bp, Helianthus annuus
gaccgtagccaatcaaatctcaaaagcatccactttacacactgaaatgtgtgaactgtgaaccgttaaataccttccaccgcctcaaactcccaccgtcgtcaccggaatatctgatcggaataccagatctagtcgccggagatacaataacagacactaaacttacaatttcagataaacgcgaagagaaatggcaacggcgagagtagatctggacggaaacacgataactccgatgacaatatgcatgatcggcgccggaggttttatcggctcgcatttgtgcgagaagctgatggcggagacgccgcacacggtgttagccgttgatgtgtataatgataagatcaaacacctgcttgaaccggactctcttccgtggaacggtcgcattcagttccaccggcttaatatcaagaacgattctcgtctcgaaggactcattaagtgctccgatctgactataaatttggcagctatttgcactcccgcggattacaatacacgtcctcttgatactatctacagcaatttcattgatgcacttcctgtggttaagtactgctccgagaacaacaagaggctcattcacttctctacgtgtgaagtatatggcaagacaataggtagctttcttcccaaagacagccccttacgtcaggatcctgcttactacattctcaaagaagacacatccccatgcatctttggctcagttgagaagcagagatggtcgtatgcatgtgctaaacaattgatagagaggctaatatacgccgagggtgcagagaacggtctcgagttcaccatagtaagacctttcaactggattggccctaggatggatttcattcccggaatcgatggtcccagtgagggcgttccaagagttctagcctgctttagcaataatctcttgagaagggagcctctcaagcttgtggatggcggtgaatcacaaagaacctttatttacatcaaggatgccattgaggctgttcttttgatgattgaaaatccagcaagagctagtggtcatatcttcaatgtaggcaaccctaacaatgaagttacagtcagacaacttgctgaaatgatgactaaggtgtattcgaaagtaagtggagaagaggcaatagagagtcccaccattgatgtcagctccaaagagttctatggagaaggttatgacgacagtgataaaagaattccagacatgaccatcataaacaaacaattaggttggaatcccaagacatccctttgggacttgttggaatcgacacttacatatcaacacaggacatatgctgaagccatcaagcaagcaattgcaaaaccaacagcaaattaaaaatgtaaggatacttgttctgcgtcgttttggttcttttttcatagtcatcatcgtatatctatctggttgaggttcgggttcgttttctcatatatacacaaacattatatttctttcatacacatttatatcaacagttgctaagagaagtttgtacttgtaatgtctaaggaaatctgagtgttttgtgttgtattcttttgttagagagagattatttgtgctataattt

SEQ ID NO: 4759 - DNA, 1745 bp, Helianthus annuus
aggcacgtaactggtaaccgacagtcccctcgcgctgcaatccagtgccctaacgtccacggtaacatcaccatccccctctccacatcgttagatcactagtccacacgtacaaccgtactcgtgaccgtcgccaatcaaatctcaagagcatccactttacacactgaaatgtgtgaactgtgaaccgttaataccttccaccgcctcaaactcccaccgtcgtcaccggaatatctgatcggaataccagatctagtcgccggagatacaataacagacactaaacttacaatttcagataaacgcgaagagaaatggcaacggcgagagtagatctggacggaaacacgataactccgatgacaatatgcatgatcggcgccggaggttttatcggctcgcatttgtgcgagaagctgatggcggagacgccgcacacggtgttagccgttgatgtgtataatgataagatcaaacacctgcttgaaccggactcgcttccgtggaacggtcgcattcagtttcaccggcttaatatcaagaacgattctcgtctcgaaggactcattaagtgctccgatctgactataaatttggcagctatttgcactccagcggattacaatacacgtcctcttgatactatctacagcaatttcattgatgcacttcctgtggttaagtactgctccgagaacaacaagaggctcattcacttctctacgtgtgaagtatatggcaagacaataggtagctttcttcccaaagacagccccttacgtcaggatcctgcttactacattctcaaagaagacacatccccatgcatctttggctcagttgagaagcagagatggtcgtatgcatgtgctaaacaattgatagagaggctaatatacgccgagggtgcagagaacggtctcgagttcaccatagtaagacctttcaactggattggccctaggatggatttcattcccggaatcgatggtcccagtgagggcgttccaagagttctagcctgctttagcaataatctcttgagaagggagcctctcaagcttgtggatggcggtgaatcacaaagaacctttatttacatcaaggatgccattgaggctgttcttttgatgattgaaaatccagcaagagctagtggtcatatcttcaatgtaggcaaccctaacaatgaagttacagtcagacaacttgctgaaatgatgactaaggtgtattcgaaagtaagtggagaagaggcaatagagagtcccaccattgatgtcagctccaaagagttctatggagaaggttatgacgacagtgataaaagaattccagacatgaccatcataaacaaacaattagggtggaatcccaagacatcgctttgggacttgttggaatcgacacttacatatcaacacaggacatatgctgaagccatcaagcaagcaattgcaaaaccaacagcaaattaaaaatgtaaggatacttgttctgcgtcgttttggttcttttttcatagtcatcatcgtatatctatctggacgaggttcgggttcgttttctcatatatacacaaacattatatttctttcatacacatttatatcaacagttgctaagagaagtttgtacttgtaatgtcttaaggaaatctgagtgttttgtgttgtattctttcgttagagagagattatttgtgctataatttattatttatttgacctaaaaaaaaaaaa

SEQ ID NO: 4760 - DNA, 1700 bp, Actinidia deliciosa
  misc_feature (24)..(24): n is a, c, g, or t
  misc_feature (33)..(33): n is a, c, g, or t
  misc_feature (36)..(36): n is a, c, g, or t
  misc_feature (54)..(54): n is a, c, g, or t
  misc_feature (70)..(70): n is a, c, g, or t
  misc_feature (873)..(873): n is a, c, g, or t
  misc_feature (904)..(904): n is a, c, g, or t
  misc_feature (910)..(910): n is a, c, g, or t
ctctcattagcctaatctagaagngaaaatccncanaaacagagattattgagngagagagagggtaatngtagagcgagaaagcttgtagagagtgagaatggcgtcggcggcgagggtagatctggacgggaacccgataaaggcgatgacgatatgcatgataggggcgggcgggttcatagggtcgcacctgtgcgagaagctgatggcggagacgccgcacaaggtgttggcggtggatgtttacaatgacaagatcaagcacctcctcgaaccggcttcgcttccctgggccggtcgcatccagttccaccgcatcaacatcaagaacgattctaggctcgaaggcctcatcaagatggcagatctgaccataaatctagcagcgatctgtactccggccgattacaatacacgccctcttgatacaatctacagcaatttcattgatgctctccccgtggttaagtattgttcggaaaataacaagcgtcttattcacttctctacttgtgaagtctatgggaaaacaattggaagctttcttcccaaagatagccctatgcggcaggaccctgcttattttattcttaaagaagatgcttctccatgcatttttggctctattgagaagcagaggtggtcctacgcttgtgcaaagcaattgattgagaggctagtctatgctgagggtgccgagaatggtcttgagttcactatcgtgagacctttcaactggattggtcctaggatggacttcatacctggcattgatggtcccagtgagggtgttcctagggttctggcatgcttcagtaataatcttcttagaggtgagccgctgaagcttgtggatggtggccaatcacnaagaacctttgtatatatcaaggacgccatngaagcngttctgctgatgattgaaaatccagccagggctaacggtcacatattcaatgtcggcaaccctaacaatgaagtcaccgtcaggcaacttgctgaaatgatgacagaggtttattccaaggtgagtggagaacccgctctggaagtacccaccattgacgtaagctccaaagaattctatggtgaagggtacgacgacagtgacaagaggattccagacatgaccataatcaacacgcaacttggttggaaccctaggacctcactttgggacttgctcgaatccacccttacctatcaacacaggacgtatgccgaagccataaagcaggccatttcaaaaccggtcgtgtccagctaagaaaagaacctttttctaaccttcaacatggaaggtagtttcttgcggtaggttgtactggttgggcatttatctcgtttctttcgaaggaggctattaaatacgtaactagataattcgttgtcctatacgctacatgtttcggtctttgttgtgtctcgggtcgatagttgacagatgttcatgggtttgtattaatgtgtatcttaagaagacagaaaacttgatgttaaggaaaaaaattataccacgacggtgatgttagggacccgtcttatagtttcgactacacctacaacgggggggcattatacacaggaagcccggacctcttttttcggagattcattccattcacttgagacttcaaagaagtatgttgtattatttgtttgacccattctaatctctccctccctctctctctctc

SEQ ID NO: 4761 - DNA, 1740 bp, Cajanus cajan
tacggggggtcgtcgttgtcttctcctcctctccctattctatatatcacccactctcactcccggtcaaaaaccaccaaattcgccatcgcatcacacgaaaaaaagcccaatggcgcgagtggatctggacggaaagcccatcaagcccatgacgatctgcatgatcggcgccggcggcttcatcgggtcgcacctctgcgaaaaactcatgtcggaaacccctcacaccgtcctcgccctcgacgtctacagcgacaagatcaagcacctcctcgagccccgattccctcccctgggccggccgcattaccttccaccgcctcaacatcaagcacgactctcgcctcgaaggcctcatcaagatggcagatctcactataaatctcgctgctatctgcacccccgcggattacaacacgcgccctctcgacaccatttacagcaacttcatcgacgcgctccccgtcgtgaaatactgctcggagaacaacaagcgccttatccatttctccacttgcgaagtctacggaaaaacgatcggaagctttctccctaaagatagtcctctccgcaaggatccggcgtactttgttcttaaagaagatgagtctccctgcatttttggtccaattgaaaagcagaggtggtcttatgcctgtgcaaaacagttgattgagaggctgatttatgctgagggtgcggaaaatggcatggagttcacaattgtgaggccttttaattggattggacctcgaatggatttcattcctggcattgatggtccaagtgagggtgttcctcgggttcttgcatgctttagcaataatcttctcagaggagagcccctcaagcttgtggacggtggccagtcccagagaacctttgtttacattaaagatgctattgaagctgtcttattgatgattgaaaatcctgccagggccaatggccatatatttaatgtgggcaacccaaacaatgaggttactgttaggcagcttgctgaaataatgatcaaggtttactcaaaggtaagtggagaaccacttcctgaaacacctactattgatgtcagctcaaaagaattttatggtgagggatatgatgatagtgacaagaggattcctgacatgaccataataaacaagcagcttggatggaatcctaagacttcactttgggacctgcttgaatccactctgacctatcaacacaggacatatgctgaagccattaagaaagtcattgcaaaacccgttgcaagttaagcttacatagagatggtgatgtgctgcctttgagaagggcgttcttgcccaagtgttctgccatattttactggttgattttatataaatggtaaattttcctccttttggtttcggtagtcagtaggcaatagcccacataggcccacgccttaatgtatgttcctggagaagtaggaatatatatagggcaacttgtgctgctatgtaattttaatgtagagacttcgcgctactatacatgttgaggtcattttatatatatactagggaagacgtttttctgtgtttttttaggggtctctcaattattgctttgttgtctttccaggtcagctgtaagttgtatcattctgtttggccctcttaagccatgtgttcttaattatttgtcattaatttaatttatggatattttttgttcctaattttcccccattgttgcaatctgagattttttgcaagtaac

SEQ ID NO: 4762 - DNA, 1605 bp, Gossypium hirsutum
ttgctgattcttcattgtcacagccggcgtttagagatcgtagaaaaatataccggcgttcgttttcaaatggcggcgagaatggatctggacggtaggccgataaagccgatgacgatatgcatgatcggagccggaggcttcattggctctcacctttgtgagaaactgatggcggagacaccgcataaagtgcttgcattggatgtttacaatgataagatcaaacacctcctcgagcccgactctttgccttgggctggccgtatcgaatttcaccgaattaacatcaagcatgattctaggctagaaggccttgtcaagatggcagatctcacgataaatcttgcggcgatctgtactccggcagattacaatacgcgtccactggacacaatttatagcaatttcattgatgcacttcctgtggtgaagtactgttctgagaacagcaaacgtctcattcacttctctacttgtgaagtttatggcaaaaccattggaagctttcttcctaaagattctcctctccgtaaggatcctgcttactatgttctcaaggaagatacttcgccttgcatttttggttcaatagagaaacagaggtggtcgtatgcatgtgctaagcaattgatcgagaggcttatctatgctgagggtgcggagagtggccttgatttcaccattgtgaggccttttaactggattggaccaaggatggatttcattcccggcattgatggtccaagtgaaggagttccaagagttctggcatgctttagtaataatctgctacgtcgtgagccacttaagcttgttgatggtggccaatcccagagaacttttgtttacattaaggatgccattgaagctgttcttttgatgattgaaaacccagatagggccaatggtcatattttcaatgtgggtaacccaaacaatgaagtcacagttaggcaacttgctgaaatgatgactcaggtctataccaaggttagtggagaacctatgttgcagtcaccatctattgatgtcagctccaaggaattttacggtgagggatatgacgatagcgacaagagaatcccggacatgaccataataaataaacaactcggttggaaccccaagacatccctttgggacttacttgaatcgactcttacctaccaataccggacttacgccgaggccattaagaagtccatggcaaaaccaactgcatcctaaaggggcaagattgtttagaccacgcacacaagtaaggactcgcgtaaaatatatgcttttgttcttttacgtttggattcttaaaattctttttaggaagtcttatatataaatatatcttcattgttgattttggtttatattttttagacttgtctgcatctgtagttaagttcttagtgtggtacttttatatggaaacattagatttttattgttttagcgttatatgttattatttcaatagaaagcttttggactccattttctgatttctggattgtgctgtatttatactctctcgggattttgtttcttaaattatattattttataattttccatgtataaaaaaaaaaaaaaaaaactcgagac

SEQ ID NO: 4763 - DNA, 1624 bp, Manihot esculenta
cttttcccaatcatataatctttcttcagttacccttgtttcggcatcctcggcgcacgtcagcttgcacaaccgctactgctattaaatagacaggcgcgtacaaacatttccgtttttgtttggcgctacttggtgattgtttgagacgatggccacaggtaatagggtggatctggatgggaggccgataaatccgatcacaatatgcatgatcggggccggaggtttcataggctctcacctatgcgagaagttgttgttagagacgccacacaagatcctcgctcttgatgtctacaatgacaagattaagcacctcctcgagccggcctcacttccctgggctgaccggatccagttccatcgcctcaatatcaagcatgattcgcgccttgaaggcctcatcaagatggcggatctgacgataaatctggcggctatttgtactccggccgattataatacgcgtccgttggacacgatttacagcaattttattgatgctctcccagtggtgaagtactgttcggagaataacaagcgtttaattcacttctcgacatgcgaggtgtatggtaaaacgattgggagctttcttcctaaagatagccctcttcgtcaggatcctgcctactacattcttaaagaagatacgtccccttgcattttcggacccattgagaagcagagatggtcctatgcatgtgcaaagcaattgattgagaggctgatatatgctgagggtgccgaaaatggccttgagttcaccattgtgagacctttcaactggattggtcctagaatggacttcattcctggcattgatggcccaagtgagggtgttccaagagttctggcatgctttagcaatgctcttttacgcagtgagccgctcaagcttgttgatggtggtcagtctcagagatctttcgtttatatcaaggatgcaattgaagctgttctgttgatgattgaaaatcctcacagggctaatggtcacatttttaacgtgggaaatccatacaatgaagttactgttaagcagcttgctgaaatgatgacaaaagtttattcagaggtaagtggagaacctgctctggaggcgccaacagttgatgtctcctccaaggaattttatggtgagggatatgacgatagtgacaagagagttccagacatgaccataatcaatagacagcttggatggaaccccaagacatcactgtgggacttgcttgaatcaaccctcacttatcaacacaagacatatgccgaggcagttaagaagaccattgcaaaacctacatccagctgaggaaacacttgagaatggaacttcttggttaggctgtttgttagcacgagttccaattcttttaagggaattttaaatatctgttagtggtttgtttcatatgagctacattttttcccccttttttttggtctttccagtgtcaatagtgagtggctcgcagttgcttaggtatcctgcattttaaatattactctttggaaggattaatagtatcttaaaagtgtattttgttgctgtaagtcttattgtgagcttgggctacaacataatgggagcattatacaaagttcattctgtttcttc

SEQ ID NO: 4764 - DNA, 1590 bp, Cichorium intybus
gattcaccacaattaattgcaagtggcccacacagacactgcatagccttcttctccctctttttttccccctcactgctttaaataccttcgtcggttaccgtcgactccatatccgatcaatccatccattgagagaaaatctagcagaaaggtatatagacccggagatataggatggcggcatcgtcggcgagggtagatctggacggaaatacgataaatccgttcacgatatgcatgattggtgccggtggattcatagggtcacacttgtgcgagaaattgttgacggagacgccgcacactgtcttagccgtggacgtttacaatgacaagatcaagcaccttctcgaaccggattctcttccttgggccggtcgcatccagttccaccgcctcaacattaagaatgattcgcgcctagaaggtcttatcaagggctccgatctgacagtaaatctagccgcgatctgcacaccggcggactacaatacgcgtcctcttgacacgatttacagcaatttcatcgacgcgctccctgtggttaagtactgttcggagaacaacaaacggctgattcacttctcaacttgtgaagtatacgggaaaaccatcggtagctatcttcctaaagatagccccttacgacaggatcctgcttactatattctcaaagaagacacatccccttgcatttttggctcaattgagaaacaaagatggtcttacgcatgtgcaaaacaactgatcgagaggctaatctatgctgaaggcgctgaaaatggccttgaattcaccattgttagacctttcaactggatcggccctagaatggatttcattccagggatcgatggtcccagtgaaggtgttccaagagttcttgcctgctttagtaataatctccttaggcgtgagcctcttaagcttgtagacggtggtgaatctcagagaacctttgtttatatcaaggatgccattgaagctgttcttttgatgattgaaaatcctggtagagctaatggtcatatcttcaatgtcggtaaccccaacaatgaagttacagtcaggcaacttgctgaaatgatgaccaaggtgtattcgaaagtaagcggtgaagattcaatagagactcccaccattgatgtaagctcaaaagaattttacggtgaaggttatgatgacagtgacaagagaattccagacatgactattattaacaaacaattaggttgggatccaaagacatcactttgggacttactggaatcgacacttacttaccaacacaggacatatgcggaagcagtgaggcaatcgattgcaaaaccagttgcgagttagtgacgtgtgctttttaaaactttttaaacagtggtcgatggagagtatttatttgttgattttattttgtgggatatttgttttactgtcgaaagtagtttgtagttgaacactttgatgtataatgttggtgtgctgtcattgccaccaccaaagaattgggttttgctttttgtttcttgtctttcactgttccagtaagtgtcatattctttatttaggtggactttgtcgtaatttgtt

SEQ ID NO: 4765 - DNA, 1680 bp, Populus trichocarpa
ccatccaaaaaaactctcatttctgtccattttctcttcagaaaacacttaattccctccctccctctctgtgattcctagcaatggcagcatcaacggtgaggattaatcttgatggaaaaccgataaatcagctaacaatattgatgatcggtgccggtggtttcatcgggtcccacctctgtgagaagatcttgcaggaaactccacacaagatcctagctcttgatgtctacagtgacaagatcaagcaccttctcgaaccggatagtctcgaatgggctggccggatccagtttcaccgtatcaatattaagcacgattctcgcctcgaaggcctaattaagatgtcagatctgacgataaatctggcggcgatctgtactccagcggattataatacgcgtcctttggatacgatttatagcaactttattgacgcgctgcccgtggtgaagtactgttcagagaatgggaagcgtttgattcacttctcgacttgtgaagtgtatggaaaaactattggtagttttcttcctaaagatagtcctcttcgtcaggaccctgcatactatgtcctcaaagaagatgcctctccctgcattttcggttctatcgagaagcagaggtggtcctatgcatgtgcaaagcagttgattgagaggttgatttatgctgagggtgcagagaatgggcttgagttcaccattgtgaggcccttcaactggattggacccagaatggatttcatacccggcattgatggcccaagtgagggtgttcccagggttctggcatgcttcagcaatgctcttcttcgtcgtgagcaactcaagcttgttgatggtggtgaatcccagagaacttttgtttacatcaaggatgccatagaggcggtcctcttgatgattgaaaatcctgacagggccaacggtcatatttttaatgttggcaaccctaacaatgaagtcactgttaggcagcttgctgaaatgatgacagcggtctacgcaaacgtaagtggcgaacctgcactggaggaacccacagttgatgtcagctccaaagagttctacggtgaaggatatgacgatagtgacaagagaattccagacatgaccataatcaataaacaacttggttggaaccccaagacatctctgtgggacttgcttgattcaaccctcacttatcaacacaagacgtatgccgaggcagtcaagaaggttatctcaaaacccacaaccagctgaagaaataaaccagacatgagaaaagatgtattcttggacgggctggtaattagcaggcgtttctattctttttcaaggaaatcgtaagtatatcataattggttgattcccaatacgctacaatttttgtttttccgggtgtcggtggtcagtggcgtactgtagctcaggaatgtgttctgaacgttaaacctcgagaatatattagattctgatcagcaagtacatctgtcttactgtaatttgtcacttggagcatgggttgccacataaagggggcgttatacaagcttgttctatttctttagaggggtttgcatgtccgtgcccccattctgtttctgctgcaaagtgttgtattaatttgtttaccctcttaagcctttttccttcaaattattatttattaattccagtcttcttcacc

SEQ ID NO: 4766 - DNA, 1680 bp, Populus trichocarpa
ccatccaaaaaaactctcatttctgtccattttctcttcagaaaacacttaattccctccctccctctctgtgattcctagcaatggcagcatcaacggtgaggattaatcttgatggaaaaccgataaatcagctaacaatattgatgatcggtgccggtggtttcatcgggtcccacctctgtgagaagatcttgcaggaaactccacacaagatcctagctcttgatgtttacagtgacaagatcaagcaccttctcgaaccggatagtctcgaatgggctggccggatccagtttcaccgtatcaatattaagcacgattctcgcctcgaaggcctaattaagatgtcagatctgacgataaatctggcggcgatctgtactccagcggattataatacgcgtcctttggatacgatttatagcaactttattgacgcgctgcccgtggtgaagtactgttcagagaatgggaagcgtttgattcacttctcgacttgtgaagtgtatggaaaaactattggtagttttcttcctaaagatagtcctcttcgtcaggaccctgcatactatgtcctcaaagaagatgcctctccctgcattttcggttctatcgagaagcagaggtggtcctatgcatgtgcaaagcagttgattgagaggttgatttatgctgagggtgcagagaatgggcttgagttcaccattgtgaggcccttcaactggattggacccagaatggatttcatacccggcattgatggcccaagtgagggtgttcccagggttctggcatgcttcagcaatgctcttcttcgtcgtgagcaactcaagcttgttgatggtggtgaatcccagagaacttttgtttacatcaaggatgccatagaggcggtcctcttgatgattgaaaatcctgacagggccaacggtcatatttttaatgttggcaaccctaacaatgaagtcactgttaggcagcttgctgaaatgatgacagcggtctacgcaaacgtaagtggcgaacctgcactggaggaacccacagttgatgtcagctccaaagagttctacggtgaaggatatgacgatagtgacaagagaattccagacatgaccataatcaataaacaacttggttggaaccccaagacatctctgtgggacttgcttgattcaaccctcacttatcaacacaagacgtatgccgaggcagtcaagaaggttatctcaaaacccacaaccagctgaagaaataaaccagacatgagaaaagatgtattcttggacgggctggtaattagcaggcgtttctattctttttcaaggaaatcgtaagtatatcataattggttgattcccaatacgctacaatttttgtttttccgggtgtcggtggtcagtggcgtactgtagctcaggaatgtgttctgaacgttaaacctcgagaatatattagattctgatcagcaagtacatctgtcttactgtaatttgtcacttggagcatgggttgccacataaagggggcgttatacaagcttgttctatttctttagaggggtttgcatgtccgtgcccccattctgtttctgctgcaaagtgttgtattaatttgtttaccctcttaagcctttttccttcaaattattatttattaattccagccttcttcacc

SEQ ID NO: 4767 - DNA, 1528 bp, Manihot esculenta
cttggtgattgtttgacacaatggcgacggcggctgatagggtagatctggacgggaggccgataaagcctgtcacaatatgcatgatcggtgctggaggtttcataggctcccacctttgcgagaagttgttgatggagacgccgcataagatcttggctcttgatgtctacaacgataagatcaagcacctactcgagccggaatcacaatcttggggcgaccggatccagttccaccgcctcaacataaaaaacgactcacgccttgaaggcctcatcaagatggcggatctgacgataaatctggcggctatttgtactccggcagattacaatacgcgtccgttggacacaatttacagcaactttattgatgcgcttccagtggtcaagtactgttcggaaaacaacaagcgtctaattcacttctcgacttgcgaggtgtatggtaaaacgattgggagctttcttcctaaagatcaccctcttcgtcaggatcctgactactaccttcttaaagaagatgcttccccctgcatctttggacctattgagaagcagaggtggtcttatgcatgtgcaaaacaattgattgagaggttgatttatgctgagggtgcagagaatggccttgagttcaccattgtgaggcctttcaactggattggacccagaatggatttcattcctggtattgatggcccgagtgagggtgttcccagggttctggcatgctttagcaatgctctcttgcgccatgaaccactcaagctagttgatggaggtcaatctcagagatcttttgtttatatcagggatgctattgaagctgttcttttgatgatcgaaaatccagagagggctaatggtcacatttacaatgttggaaaccctaacaatgaagttacagttaggcagcttgctgaaatgatgactgaggtctattcaaaggtaagcggagaacctgctctggaggtgccaacagttgatatctcctccgaggaattttatggtgagggatatgacgatagtgacaagagagttccagacatgactataatcaatgcacatcttggttggaaccccaagacatcactgtgggacttgcttgaatcaaccctcacttatcaacacaggacatatgccgaggcagttaaaaaggccatttcacaaccttcatcatccagctaaggaaacacttgatgtttgttagaatgagtcccaattctttgttgagggaaattttaacatctgttagagtttgttctatataggctacaattttttgtcattccagcgtcaatagtcaatgcctctagtacctcagctatcctgtgtttcgaatatggatattactcctgaaaagataataggatcttattggataagtatattttgtttcctgtaaactagccttgtgagcttgggctgcgacattaatgggggaattatacaaaatttgttctgtttctttgtaggtttgcttagcatttatctgcttcatttctccacggaaatgctgtatt

SEQ ID NO: 4768 - DNA, 1773 bp, Coffea canephora
cggccggggggaacgcgagtagggccgtattctctcacagcctctgctctcacctccctccttttttctgctttaaatacggcccctcaacttccccaccgttctcctcctccgtccacctcctttaatccatcgtcaaatttcacacactcacgcactccaattacaccgtagcatttattagaacagagtagcgaaacctagggtcaaggatttcgggaagacgaaatggcaggaagagtagatctggatgggaatccgataaagccgatgacaatttgcatgattggcgccggtggattcattgggtcccacctctgcgagaaattgatgtcggaaacggagcataaagtccttgccgtggatgtctacagcgataagatcaagcatttgttggagccggcttcgctgccctgggccggccgtatccaattccaccgcctcaatattaagaacgattcccgccttgaaggcctcatcaagatggcagatcttactataaatcttgccgcgatctgtactccagctgattacaatactcgacctctcgatacaatctacagcaacttcattgatgctctcccagtggttaagtattgctctgaaaatggcaagcgtctcattcacttctctacctgtgaagtttatgggaaaacaatcggtagttttttacccaaagatagccaattgcgacaggatcctgcttattatgttctcaaggaagatacctccccttgcatttttggttccattgagaagcagaggtggtcctatgcatgcgcaaagcaattaattgagagattgatctatgctgagggtgctgaaaacggtcttgagtttaccattgttaggccctttaactggattggtcctagaatggatttcatacctggaattgatgggcccagtgagggtgttccaagagttctggcatgctttagtaataatctattgaggcgtgagcccctaaaacttgttgatggaggccaatcacagagaacctttgtttacattaaagatgcaattgaagctgttcatctgatgattgaaaatcctgctagggcaaatggtcagattttcaatgtgggtaatcctaataatgaagttacagtcaggcagctagctgaaatgatgacagaggtttatgcaaaggttagtggagagcctccactagaagcggctaccatagatgtaagctccaaagaattttatggtgaaggttatgatgatagtgataaaagaattcctgatatgactataatcaacaaacaactgggatggaatcccaaaacatctctctgggatctacttgattccacccttacctatcaacacaggacatacgcagaggctatcagaaaagcaatttcaaagcctgttgcaagttaagaaacagtatagtgtggttctttctcaagtgctacttgttggcaggtcttgcaattctttctacggatctgttgagtatatctatatggttcattgtcatatacgccacattttttcactttcaaagtgttcctagtccatagcgtgcagttacaaggaacatgaaactcaatgttggtcttaagggcgggattttagtaggaagacttgtgatgctttatctaagacactttggagaactatagaaggatagatgtactgtttgtaatttgtggtcactcatctgctgcttaatgcataccacaactatacgggatcatgttgtatcattttgttctgcctcttcaggcttcatttccctaatatattattctttttgtgact

SEQ ID NO: 4769 - DNA, 1255 bp, Mimulus guttatus
tccccgattccaaatccccaattgcataattgataatccacgcgcattatttcaaaatcaaaaacctatcgaaatccgcatagaaaatggcgagttcgagagcagatctggacggaaattcgattaagccgatgactatatgcatgatcggcgccggaggtttcatcggctcacatttgtgcgagaagctgatggcggagacgccgcacaaggtgctggcggtggatgtgtacaatgacaagatcaaccacctcctcgagccttcctcctcgccttgggccgaacgcatccagttccaccgaatcaacattaagaacgactctcgcctcgaaggcctcattcgcatggcggatcttaccattaaccttgctgctatatgcactccagcagattacaacacgcgacctcttgacacaatttacagcaatttcattgatgctctccctgtggttaaatactgctctgaaaatagcaaacgcctcatacatttctcgacttgtgaagtttatgggaaaacggttggttgctttttacccaaagatagccctttacgacaggaacctgctaattacgttctgagcgaagatacctccccttgcatttttggccctattgagaaacagaggtggtcatatgcatgcgcaaagcagttgattgagaggctgatctatgctgaaggtgctgagaatggtcttgaatttacaattgtgcgacccttcaattggattggtcccagaatggatttcatacctggaattgatggtccaagtgagggtgttccgagagttctggcctgctttagcaataatctattgaggggtgaaccactgaagcttgtggatggtggcgaatctcagagaacctttgtttatattaaggatgccatcgaagctgttcttttgatgattgaaaatccagccagggctaatggtcatatatttaacgtgggcaatcctaacaatgaagttacggtcagacagcttgccgaaatgatgactcaggtttacacgaaggttagtggagagccagcactagcatcacctaccattgatataagctccaaagagttctatggtgaaggatatgatgatagtgacaagagaattccagacatgacgataatcaaccgacaacttggatggaacccaaagacatcactttgggacttgcttgaatcaactcttacttaccaacacagaacatacgccgaagccgtaaagaaatctacttcagtaccggtttcaagttaaaaaaa

SEQ ID NO: 4770 - DNA, 1601 bp, Artemisia annua
tccaacggggacacacacacacacaaatcctccttatcaatcacaaccgtccatttcgtcacgatgacgtcatcagccagagtagatctggacggaaacgccataaaacccttaacaatatgcatgatcggcgcaggaggatttatcggatcacatttatgtgagaagctgatgaacgagactgatcatacggttttagcagttgatgtttataatgataagattaagcatttgcttgagcctgattccttgccttggaatggtaggattcagtttcataggttgaatattaagaatgattccaggcttgaaggtctcatcaaatgctccgatctgacagtaaatctagctgctatctgcacaccagcggattacaatactcgtcctcttgacacgatttacagcaacttcatcgatgcactccctgtggtcaagtactgttcggagaataacaagaggctcattcatttctcgacttgtgaagtatatgggaaaactattggtagctatcttcccaaagatagccccttgcgccaggaccctgcttattatattctgaaagaagatacttccccttgcatttttggctcaatcgagaagcagaggtggtcttatgcatgtgcaaaacagttgattgagaggctcatctatgccgagggtgccgagaatggccttgagttcaccattgtaaggccattcaactggatcggcccaaggatggatttcattcccgggattgatggtcccagtgagggtgttccaagagttctcgcatgctttagcaataatcttctcaggcgtgagcctctgaagcttgtggatggcggtgaatcacagagaaccttcgtttatattaaggatgctattgaagctgttcatttgatgattgaaaatcctgctagagctaatggtcatatcttcaatgtgggtaaccctaacaatgaagttactgtcagacaacttgctgaaatgatgaccaaggtatatgcaaaagtaagtggagaagattctatagagacccccaccattgatgtaagctccaaagagttttacggtgaaggttatgatgacagtgacaagagaattccagacatgaccatcattaacaagcaattaggttgggatccaaagacatcgctatgggacttgctagaatccacacttacctaccaacacaggacatatgcagaagcagtgaaacaatccatttcaaaaccaatagccaattaaaagtgtggaaaatgaggtcatctggttctcttagtctttctgcatctgtgtgtacgatcctcctgtaatacctttatagaatgctacggtgtctattggttcattttattgtgtttttttccatgtccaaaatagttagttgttaggagactttgcacttgtaatgtgtagtaaggaaactatgcctgtataatgctctgtgcaccaccaaagaattcacttcatgcgtacttttcctggcagtaccagtatgtgctaaggggagttcggtttttgtttgttatctttcgcttaaagaacaagtgtcgtattctttcattaggtcttgtaccggaccttgtcttaatttaataaattatcgttacatgtgt

SEQ ID NO: 4771 - DNA, 1659 bp, Coffea canephora
  misc_feature (17)..(17): n is a, c, g, or t
ctgcaggctttaatccntcgtcaaatttcacacactctcgcactccaattacaccgtagcatttattagaacagagtagcgaaacctagggtcaaggatttcgggaagacgaaatggcaggaagagtagatctggatgggaatccgataaagccgatgacaatttgcatgattggcgccggtggattcattgggtcccacctctgcgagaaattgatgtcggaaacggagcataaagtccttgccgtggatgtctacagcgataagatcaagcatttgttggagccggcttcgctgccctgggccggccgtatccaattccaccgcctcaatattaagaacgattcccgccttgaaggcctcatcaagatggcagatcttactataaatcttgccgcgatctgtactccagctgattacaatactcgacctctcgatacaatctacagcaacttcattgatgctctcccagtggttaagtattgctctgaaaatggcaagcgtctcattcacttctctacctgtgaagtttatgggaaaacaatcggtagttttttacccaaagatagccaattgcgacaggatcctgcttattatgttctcaaggaagatacctccccttgcatttttggttccattgagaagcagaggtggtcctatgcatgcgcaaagcaattaattgagagattgatctatgctgagggtgctgaaaacggtcttgagtttaccattgttaggccctttaactggattggtcctagaatggatttcatacctggaattgatgggcccagtgagggtgttccaagagttctggcatgctttagtaataatctattgaggcgtgagcccctaaaacttgttgatggaggccaatcacagagaacctttgtttacattaaagatgcaattgaagctgttcatctgatgattgaaaatcctgctagggcaaatggtcagattttcaatgtgggtaatcctaataatgaagttacagtcaggcagctagctgagatgatgacagaggtttatgcaaaggttagtggagagcctccactagaagcggctaccatagatgtaagctccaaagaattttatggtgaaggttatgatgatagtgataaaagaattcctgatatgactataatcaacaaacaactgggatggaatcccaaaacatctctctgggatctacttgattccacccttacctatcaacacaggacatacgcagaggctatcagaaaagcaatttcaaggcctgttgcaagttaagaaacagtatagtgtggttctttctcaagtgctacttgttggcaggtcttgcaattctttctacggatctgttgagtatatctatatggttcattgtcatatacgccacattttttcactttcaaagtgttcctagtccatagcgtgcagttacaaggaacatgaaactcaatgttggtcttaagggcggcatttttagtaggaagacttgtgatgctttatctaagacactttggagaactgtagaaggatagatgtactgtttgtaatttgtggtcactcatctgctgcttaatgcataccacaactatacgggatcatgttgtatcattttgttctgcctcctcaggcttcatttccctaatatattattcttttcgtgact

SEQ ID NO: 4772 - DNA, 1612 bp, Gossypium hirsutum
caccttgtggctgattcttcattgtcacagccggcgtttagagatcgtagaaaaatataccggcgttcgttttcaaatggcggcgagaatggatctggacggtaggccgataaagccgatgacgatatgcatgatcggagccggaggcttcattggctctcacctttgtgagaaactgatggcggagacaccgcatagagtgcttgcattggatgtttacaatgataagatcaaacatctcctcgagcccgactctttgccttgggctggccgtatcgaatttcaccgaattaacatcaagcatgattctaggctagaaggccttgtcaagatggcagatctcacgataaatcttgcggcgatctgtactccggcagattacaatacgcgtccactggacacaatttatagcaatttcattgatgcacttcctgtggtgaagtactgttctgagaacagcaaacgtctcattcacttctctacttgtgaagtttatggcaaaaccattggaagctttcttcctaaagattctcctctccgtaaggatcctgcttactatgttctcaaggaagatacttcgccttgcatttttggttcaatagagaaacagaggtggtcgtatgcatgtgctaagcaattgatcgagaagcttatctatgctgagggtgcggagaatggccttgatttcaccattgtgaggccttttaactggattggaccaaagatggatttcattcccggcattgatggtccaagtgaaggagttccaagagttctggcatgctttagtaataatctgctacgtcgtgagccacttaagcttgttgatggtggccaatcccagagaacttttgtttacattaaggatgccattgaagctgttcttttgatgattgaaaacccagatagggccaatggtcatattttcaatgtgggtaacccaaacaatgaagtcacagttaggcaacttgctgaaatgatgactcaggtctataccatggttagtggagaacctatgttgcagtcaccatctattgatgtcagctccaaggaattttacggtgagggatatgacgatagcgacaagagaatccctgacatgaccataataaataaacaactcggttggaaccccaagacatccctttgggacttacttgaatcgactcttacctaccaataccggacttacgccgaggccattaagaagtccatggcaaaaccaactgcatcctaaaggggcaagattgtttagaccacgcacacaagtaaggactcgcgtaaaatatatgcttttgttcttttacgtttggattcttaaaattctttttaggaagtcttatatataaatatatcttcattgttgattttggtttatattttttagacttgtctgcatctgtagttaagttcttagtgtggtacttttatatggaaacattagatttttattgttttagcgttatatgttattatttcaatagaaagcttttggactccattttctgatttctggattgtgctgtatttatactctctcgggattttgtttcttaaattatattattttataattttccatgtatcaaaaccccaaaaaaaaactcgagac

SEQ ID NO: 4773 - DNA, 1603 bp, Lactuca sativa
cattttgtttgtatacgcgcgagaacacggatcacaaatgtcgaattaaccacaattaatagcaatgtggcccacacaccctgcgtaaatcactttctccctcttttttctcactgctttaaataccttcctccatcaccgacgacgccatatccgatcatatccagtccatcgagagaaaatctagcagaaagctactcatccccggagatttagcatggcggcatcgtcggcgagggtagatctggacggaaatacgataaatccgttcacaatatgcatgattggtgccggtggattcattggctcacacttgtgcgagaaattgttgacggagacgccgcacactgtcttggcggtggacgtttacaatgacaaaatcaaacaccttctcgaggggccggattcccttccttgggctggtcgcatccagttccaccgcctcaacattaagaatgattcgcgcctcgaaggtcttatcaagtgctccgatctgacagtaaatctagccgcgatctgcacaccggcggactacaatacgcgtcctcttgatacgatctacagtaatttcatcgacgctctccctgtggttaagtactgttcagagaataacaagcggctcattcacttctccacttgtgaagtatacgggaaaaccattggtagctatcttccccaagatagccccttgcgacaggatcctgcttactatatccttaaagaagatacatccccttgcatttttggcccaattgagaaacaaaggtggtcttatgcatgcgcaaaacaattgatcgagaggctaatctatgctgagggtgctgaaaatggccttgaattcaccattgttagacctttcaactggatcggccctaggatggatttcattccagggattgatggtcccagtgaaggtgttcccagggttcttgcttgctttagcaataatcttctcagacgtgagcctttgaagctagttgatggtggtgaatctcaaaggacctttgtctatatcaaggatgccattgaagctgttcttttgatgattgagaatcctgctagagctaatggtcatatcttcaatgttggaaaccccaataatgaagttacagtgaggcagctagctgaaatgatgaccaaggtgtattcaaaagtaagtggtgaagattcaatagagactcctactgttgatgtgagctccaaagagttttatggtgaaggttatgatgatagtgacaagagaattccagacatgaccattattaacaaacaattaggttgggatccgaagacatcactttgggatttgctggaatcgacacttacctatcaacacaggacatatgcggaagcagtgaagcaatccgttgcaaaagcagtagctagttaaagacagttagtgatgtgtgcttttaaaactcaacttttctctgtataatgtttttatgtgctgtgaattgccaccaccaaaaaaaaaattgggttttgcttttgctacttttgcttttcttttagtttgttgtctttcggtattccattaaatgtcgtatttaggtcttggaccatgtcataatttattaatttattgtcacataatatatta

SEQ ID NO: 4774 - DNA, 1637 bp, Lactuca sativa
  misc_feature (113)..(113): n is a, c, g, or t
cattttgtttgtatacgcgcgagaacacggatcacaaatgtcgaattaaccacaattaatagcaatgtggcccacacaccctgcgtaaatcactttctccctcttttttctcnctgctttaaataccttcctccatcaccgacgacgccatatccgatcatatccagtccatcgagagaaaatctagcagaaagctactcatccccggagatttagcatggcggcatcgtcggcgagggtagatctggacggaaatacgataaatccgttcacaatatgcatgattggtgccggtggattcattggctcacacttgtgcgagaaattgttgacggagacgccgcacactgtcttggcggtggacgtttacaatgacaaaatcaaacaccttctcgaggggccggattcccttccttgggctggtcgcatccagttccaccgcctcaacattaagaatgattcgcgcctcgaaggtcttatcaagtgctccgatctgacagtaaatctagccgcgatctgcacaccggcggactacaatacgcgtcctcttgatacgatctacagtaatttcatcgacgctctccctgtggttaagtactgttcagagaataacaagcggctcattcacttctccacttgtgaagtatacgggaaaaccattggtagctatcttccccaagatagccccttgcgacaggatcctgcttactatatccttaaagaagatacatccccttgcatttttggcccaattgagaaacaaaggtggtcttatgcatgcgcaaaacaattgatcgagaggctaatctatgctgagggtgctgaaaatggccttgaattcaccattgttagacctttcaactggatcggccctaggatggatttcattccagggattgatggtcccagtgaaggtgttcccagggttcttgcttgctttagcaataatcttctcagacgtgagcctttgaagctagttgatggtggtgaatctcaaaggacctttgtctatatcaaggatgccattgaagctgttcttttgatgattgagaatcctgctagagctaatggtcatatcttcaatgttggaaaccccaataatgaagttacagtgaggcagctagctgaaatgatgaccaaggtgtattcaaaagtaagtggtgaagattcaatagagactcctactgttgatgtgagctccaaagagttttatggtgaaggttatgatgatagtgacaagagaattccagacatgaccattattaacaaacaattaggttgggatccgaagacatcactttgggatttgctggaatcgacacttacctatcaacacaggacatatgcggaagcagtgaagcaatccgttgcaaaagcagtagctagttaaagacagttagtgatgtgtgcttttaaaactcaacttttctctgtataatgtttttatgtgctgtgaattgccaccaccaaaaaaaaatttgggttttgcttttgctacttttgcttttcttttagtttgttgtctttcggtattccattaaatgtcgtatttaggtcttggaccatgtcataatttattaatttattgtcacataatatattaaaaacacaagcatatcatattttaattttcttcg

SEQ ID NO: 4775 - DNA, 1469 bp, Tragopogon dubius
acgggatatccgatcaaatccaattccttcagagagaaaatctaggagaaaagtgtatttccccggagatataggatggcgacatcgtcggcgagggtagatctggatggaaacacgataaatccgatgacgatatgcatgattggtgccggtggattcataggttcgcacttgtgcgagaaattgatgtcggagacccctcacactgtgttggcagtcgacgtttacaatgacaagatcaagcacctcctcgaaccggactctcttccttgggccggtcgcatccagttccaccgcctcaacattaagaatgattcgcgacttgaaggtcttatcaagtgctccgatctgacggtaaatctagctgcgatctgcacaccggcggattacaacacgcgtcctctggacacgatttacagcaatttcatcgatgcgctccctgtggtcaagtactgttcagagaataacaaacggctcattcacttctccacttgtgaagtctatgggaaaaccattggtagctaccttcctcaagatagccccctgcgacaggatcctgcttattatattcttaaagaagatacatccccttgtatttttggcccaattgagaagcagaggtggtcttatgcatgtgcaaaacagttgattgagaggctaatctatgccgagggtgctgagaatggtatggagttcaccatagttaggcctttcaactggattggccctaggatggatttcattccagggattgatgggcccagtgagggtgttccaagggttcttgcctgcttcagtaataatcttttaaggcgtgagcctcttaagcttgtggatggtggtgaatctcagaggacctttgtttatatcaaggatgctattgaagctgttcttctgatgattgaaaaccctgctagggctaatggtcatatcttcaatgtgggtaaccctaacaatgaagtgacagtcaggcaacttgctgaaatgatgaccaaggtatactcgaaagtaagtggagaggattcaatagagactcctacgatcgacgtaagctcgaaagaattttatggtgaaggttatgatgacagtgacaagagaattccagatatgaccattatcaacaaacaattaggttgggatccaaagacatcactttgggacttgctggaatccacacttacctaccaacacaggacatatgcagaagcagtgaagaaatcaattgcaaaaccagtcgccaattaaaaggtttaaaactttcccatatctatcaaactagttcatagttgcaagggaacctttgtttgtataacccttaccaaagaattgggcttcatacctactttcttggcagtgtgtttattttgctttttctttatcaggtattgtctagactttgtcataatttatttatttgttcttacttgtgtttgtaatttggttaatacttcaaaaaccatcattcggat

SEQ ID NO: 4776 - DNA, 1503 bp, Tragopogon dubius
gtcgacacggatcgaatccaatccctagagcaagagagggagaaaatctagagaaacacgcagaggaaagagggggagagatggcatcaacgacggcgagggtagatctggatggaaatacgataaatccgatgacgatatgtatgattggtgctggaggattcataggttcgcacttatgtgagaagttaatgacggagacaccacacacggtgttagctgttgatgtttacaatgacaagatcaagcacctgctagaaccggacactcatccttgggctggtcgcattcagttccaccgtcttaatatcaagaatgattctcgcctcgaagggctcattaagtgttccgatctgacgataaatctggcggcgatttgcactccagcggattacaatacgcgtcctcttgacacgatttacagcaatttcattgatgcgctccctgtggttaagtactgctcagagaacagcaagaggctcattcatttctctacatgtgaagtatatgggaaaacaataggcagctatcttcccaaagatagccccttacgtcaggatcctgcgtactacattcttaaagaagatacttctccatgcatattcgggtcagttgagaagcagagatggtcatatgcatgtgcaaaacagttgattgagaggctaatttacgccgagggtgcagagaatggtcttgaattcaccatagtgagaccctttaactggattggccctaggatggatttcattcccgggatcgatggtcccagtgagggtgttccaagggttctcgcgtgctttagcaataatcttcttagacgcgaacctctgaagcttgtggatggtggtgaatcacaaagaacctttgtgtatatcaaggatgctattgaagctgttcttttgatgattgaaaatcctgcaagagctagtggtcatatctttaatgttggaaaccctaacaatgaagttacagttagagaacttgctgaaatgatgaccaaggtatattcgaaagtaagtggagaagattcaatagagactccaacgattgacgtgagttcaaaagaattttatggggaaggttacgatgacagtgacaagagaattccagacatgagcatcataaacaaacaattaggttgggatccaaaaacatcactatgggacttgctggaatccacacttacgtatcaacacaagacatatgctgaagccatcaagcaagcaattgcaaaacccgtagcaaattaaagataaataaaaaagggtaaggtgctgctgttttggttggttgtttctgtctgaatacacaatgtcatctatttttcttcttcttttcatacacgtacgtttacgtgatgttaaaagtattctacttaaaaactagtagttttgagaatgggaccaacttattcttgacctatttatctatctctacctgccaaggtggagtctcctctgttgtattcatttgtttaagatgatattactatattatttatta

SEQ ID NO: 4777 - DNA, 1711 bp, Cichorium intybus
cggggaccgatgagtgtgacctcctccctcctttttccatctgctttaataccttccttcgttccccctaaatcctcccgtcgacaccggatcgaatccattccccgagtgtctttcttcgagagagaaagagagaatctgtacccacaaagaaacacgcagagggtagtgggggcgagagagatggcatccacaacggcgagggtagatctggatggaaatacgataaatccgatgacgatatgtatgattggagctggaggattcataggctcgcacttgtgcgagaagttgatgaatgagacgccacacacggtgctagctgttgatgtttacaatgacaagatcaagcacctactcgaaccggactcacttccttgggctgggcgcattcagttccatcgtcttaatatcaagaatgattctcgcctcgagggactcatcaagtgttccgatctgaccataaatctggccgcgatttgcactccagccgattacaacacgcgtcctcttgacacgatttacagcaatttcattgatgcgctccctgtggttaagtactgttcagagaacagcaagaggctcattcacttctctacatgtgaagtctatgggaaaacaatcggtagctatcttcccaaagacagccccttacgacaggatcctgcttactatattctcaaagaagatacttccccctgcatattcggctcagttgaaaaacagagatggtcatatgcatgtgcaaaacagttgattgagaggctaatctacgctgaaggtgcagaaaatggtcttgaattcaccattgttagacctttcaactggatcggccctagaatggatttcattcccgggattgatggtcccagtgaaggtgttccaagggttcttgcctgctttagcaacaaccttcttagacgcgagcctttgaagcttgtagatggtggtgaatcacaaagaaccttcgtttacatcaaggacgccattgaagccgttcttttaatgattgaaaaccctgcaagagctagcggacatatctttaatgtgggaaaccctaacaatgaagttacagttagacagcttgctgaaatgatgacaaaggtgtattcgaaagtaagtggagaagattcaatagagacacccaccattgatgtgagctcaaaggagttttatggggaaggatatgatgacagtgacaaaagaattccagacatgactattataaacaaacaattaggttgggatccaaagacatcactgtgggatttgttggaatctacacttacatatcaacacaagacatatgctgaagcaattaagcaagctattgcaaaaccagtagcgaattaaaagcaaaaaagaaaatggaatttcaggtgatgttttggttgttttggagtatctgtttggttggttgaatgatatacacaatgttatttgtttttttcatacatctttgtaaaagtagttccactgttggggagaaatttgtggttgtaaggtgtagtagaaactactaaggatgtgttttggtatgatagttggatatgtgtctcttcctgtaaaggttgagtgtgttgttgtattcatttatttagagatgttgttggtataataatttattatttatttcccaccaatccaaaagcaatccacataacgatcgatatgtttgaaattcccatgtgcagatgcattgttctcgcac

SEQ ID NO: 4778 - DNA, 1694 bp, Lactuca sativa
gtagtcatgaaccctgtgaagtgtgaacctcctccctcctttttctatctgctttaaataccttccctcgttcccccaatatcctcccgtcgacaccggatcgaaatccgatccctaaacaaatagagaaaatctagacgcagaggagagagatggcatctacgacggcgaggttagatctggatggaaatacgataaatccgatgacgatatgtatgattggtgctggaggattcataggttcgcacttgtgcgagaagttgatgcaagagacgccacacacggtgttagctgtcgatgtttacaatgacaagatcaagcacctgctcgaaccggactctcttccttgggctgggcgcattcagttccaccgacttaatatcaagaatgattctcgcctcgaagggctcatcaagtgttccgatctgacgataaatctggccgcgatttgcactccagcggattacaacacgcgtcctcttgacacgatttacagcaatttcatcgatgcgctccctgtgctcaagtactgttcagagaacaacaagaggctcattcacttctctacctgtgaagtatatgggaaaacaattggtagctatcttcccaaagatagccccttacgacaggatcctgcttactatattcttaaagaagatgtttccccatgcatattcggatcagttgagaaacagagatggtcatatgcatgtgcaaaacagttgatcgagaggctaatttacgccgagggtgcagaaaatggtttagaattcacaatagtcagacctttcaactggattggccctaggatggatttcatccccgggattgatggtcccagtgaaggtgttcctagggttcttgcatgctttagcaataaccttcttagacgtgagcctttgaagcttgttgatggtggtgaatcacaaagaacctttgtttacatcaaggatgctattgaagctgttcttttgatgattgaaaatccaggcagggctagtggtcatattttcaatgtgggaaaccctaacaatgaagttacagttaggcaacttgctgaaatgatgactaaggtgtattcgaaagtaagtggagaagattcaatagagactcccaccattgatgtgagctcaaaggaattttatggggaaggttatgatgacagtgacaaacgtattccagacatgaccattataaacaaacaattaggttggaacccaaagacatcactgtgggatttgctggaatctacactaacatatcaacacaagacatatgcagaagcaatcaagcaagcaattgcaaaaccattagcaaattaaaagcgctataatatctatctatctatatttatatggttggttatcatcatcattcatatacacaattaatgtttgtctctctctttttttttttttttcataccacacctttttcacaaatcaaatgttgggaagaaatttgtacttgtaacttgtagtagaaaagaaactactaaggatgtattttgctgtgttaagacaccaagactagagagaagtggtttaataccaagtttttcttcttggcttgtgcggagggggcctgttttgctctccatacttgatttattccgtctctctttctgtgttgtttgtattgatttatttagggatattgtctagaaacattgtgcaataatttattatttattt

SEQ ID NO: 4779 - DNA, 1693 bp, Lactuca sativa
  misc_feature (1147)..(1147): n is a, c, g, or t
  misc_feature (1168)..(1168): n is a, c, g, or t
  misc_feature (1171)..(1171): n is a, c, g, or t
  misc_feature (1174)..(1174): n is a, c, g, or t
  misc_feature (1402)..(1402): n is a, c, g, or t
  misc_feature (1404)..(1404): n is a, c, g, or t
  misc_feature (1440)..(1440): n is a, c, g, or t
gtagtcatgaaccctgtgaagtgtgaacctcctccctcctttttctatctgctttaaataccttccctcgttcccccaatatcctcccgtcgacaccggatcgaaatccgatccctaaacaatagagaaaatctagacgcagaggagagagatggcatctacgacggcgaggttagatctggatggaaatacgataaatccgatgacgatatgtatgattggtgctggaggattcataggttcgcacttgtgcgagaagttgatgcaagagacgccacacacggtgttagctgtcgatgtttacaatgacaagatcaagcacctgctcgaaccggactctcttccttgggctgggcgcattcagttccaccgacttaatatcaagaatgattctcgcctcgaagggctcatcaagtgttccgatctgacgataaatctggccgcgatttgcactccagcggattacaacacgcgtcctcttgacacgatttacagcaatttcatcgatgcgctccctgtgctcaagtactgctcagagaacaacaagaggctcattcacttctctacttgtgaagtgtatgggaaaacaattggtagctatcttcccaaagatagccccttacgacaggatcctgcttactatattcttaaggaagatgtttccccatgcatattcggatcagttgagaaacagagatggtcatatgcatgtgcaaaacagttgatcgagagactaatttatgccgagggtgcagaaaatggtttagaattcacaatagtcagacctttcaactggattggccctaggatggatttcatccccgggattgatggtcccagtgaaggtgttcctagggttcttgcatgctttagcaataaccttcttagacgtgagcctttgaagcttgttgatggtggtgaatcccaaagaacctttgtttacattaaggatgctattgaagctgttcttttgatgattgaaaatccaggcagggctagtggtcatattttcaatgtgggaaaccctaacaatgaagttacagttaggcaacttgctgaaatgatgactaaggtgtattcgaaagtaagtggagaagattcaatagagactcccaccattgatgtgagctcaaaggaattttatggngaaggttatgatgacagtganaancgnattccagacatgaccattataaacaaacaattaggttggaacccaaagacatcactgtgggatttgctggaatctacactaacatatcaacacaagacatatgcagaagcaatcaagcaagcaattgcaaaaccattagcaaattaaaagcgctataatatctatctatctatatttatatggttggttatcatcatcattcatatacacaattaatgtttgtctttntntttttttttttttttcataccacacctttttcacanatcaaatgttgggaagaaatttgtacttgtaacttgtagtagaaaagaaactactaaggatgtattttgctgtgttaagacaccaagactagagagaagtggtttaataccaagtttttcttcttggcttgtgcggagggggcctgttttgctctccatacttgatttattccgtctctctttctgtgttgtttgtattgatttatttagggatattgtctagaaacattgtgcaataatttattatttattt

SEQ ID NO: 4780 - DNA, 1732 bp, Helianthus annuus
actcaacctgtaaaaccctaaaaaagagatattcacatccagttgatcaacatcggcgttccttcccgatcttaacatcaccactacatccatctccgtcagtccgtcaccctcactagcatatatacagacatcttcattccatcgaatccaatccattcggtcaacaaaactcaaccaaaaggtttacagttttacacactcgaagatatagcatgacgtcatcaacggcgagagtagatctggacggaaatccggtaaaaccgttaacaatatgcatgatcggtgccggaggattcatcggttcgcacttgtgcgagaaattgttgtctgaaacgcagcacactgtgttagccgtggatgtgtataatgataagatcaagcatcttctcgaaccggactcgcttccttgggccggtcgcatccagttccacaggattaatattaagaatgattctcgccttgaaggtctcatcaagtgctctgatctgactgttaatctagctgcgatctgcacaccggcggattacaatacccgtccacttgatacgatttacagcaacttcatcgatgcactccctgtggtcaagtactgttcagagaataacaagcggcttattcacttttccacttgtgaagtatatgggaaaaccatcggtagctttcttccccaagatagccctctgcgacaggatcctgcttactatattctcaaagaagacacatccccttgcatttttggctcaatcgagaaacagcgatggtcttatgcatgtgcaaaacagttaattgagaggctcatctatgccgagggtgctgagaatggtcttgagttcaccatcgtaaggccttttaactggattggccctaggatggatttcattcccgggattgacggtcccagtgagggtgttccaagggttcttgcatgctttagcaacaatctgctcaggcgtgagcccttgaagcttgtggatggcggtcaatcacagagaacctttgtttatattaaggatgctattgaagctgttcatttgatgattgaaaatccagctagagccaatggtcatatctttaatgtgggcaaccctaacaatgaagttacagttagacaacttgctgaaatgatgaccaaggtatatgcaaaggtaagtggagaagattcaatagagaccccaaccattgatgtaagctctaaagaattttatggtgaaggatatgatgacagtgacaagagaattccagacatgaccatcatcaacaaacaattaggttgggatccaaagacatcactttgggacttgctggaatccacacttacctaccaacacaggacatatgctgaagcagtgaggcaatccattgcaaaaccactagccaattgagagggtggttctggttctggttcttataatctatgtgcattcctactgtaacacttttgaagaaactgttgattatgtgttggttcatttcatcctgtgagacttgcacctgtaatgtgtagtatgggaactctgcttgtatactctgctgtgtacaccacaaagataccagctcggttttgtttttcggttgttatgttttactagtgtcgtattcttttattaggtctcgccagggccttgtcgtaatttaataaattatattcgtttgaccttttttttatatattaatttataaaaatatatttgtgtatgtattattttaatgaattatgattatctttagc

SEQ ID NO: 4781 - DNA, 1525 bp, Helianthus annuus
  misc_feature (1412)..(1412): n is a, c, g, or t
cggggttcttccgatcttaaatcaccactacatccatctccgtcagtccgtcaccctcactaccatatatacagacatcttcattccatcgaatccaatccattcgatcaacaaaactcaaccaaaaggtttacagttttacacactcgaagatatagcatgacgtcatcaacggcgagagtagatctggacggaaatccggtaaaaccgttaacaatatgcatgatcggcgccggaggattcatcggttcgcacttgtgcgagaaattgttgtctgaaacgcagcacactgtgttagctgtggatgtgtataatgataagatcaagcatcttctcgaaccggactcgcttccttgggccggtcgcatccagttccacaggattaatattaagaatgattctcgccttgaaggtctcatcaagtgctctgatctgactgttaatctagctgcgatctgcacaccggcggattacaatacccgtccacttgatacgatttacagcaacttcatcgatgcactccctgtggtcaagtactgttcagagaataacaagcggcttattcacttttccacttgtgaagtatatgggaaaaccatcggtagctttcttccccaagatagccctctgcgacaggatcctgcttactatattctcaaagaagacacatccccttgcatttttggctcaatcgagaaacaacgatggtcttatgcatgtgcaaaacagttaattgagaggctcatctatgccgagggtgctgagaatggtcttgagttcaccatcgtaaggccttttaactggattggccctaggatggatttcattcccgggattgacggtcccagtgagggtgttccaagggttctcgcatgctttagcaacaatctgctcaggcgtgagcccttgaagcttgtggatggcggtcaatcacagagaacctttgtttatattaaggatgctattgaagctgttcatttgatgattgaaaatccagctagagccaatggtcatatctttaatgtgggtaaccctaacaatgaagttacagtacgacaacttgctgaaatgatgaccaaggtatatgcaaaggtaagtggagaagattcaatagagaccccaaccattgatgtaagctctaaagaattttacggtgaaggatatgatgacagtgacaagagaattccagacatgaccatcattaacaaacaattaggttgggatccaaagacatcactttgggacttgctggaatccacacttacctaccaacacaggacatatgctgaagcagtgaggcaatccattgcaaaaccactagccaattgaaagggtggttctggttctggttcttataatctatgtgcattcctactgtaacacttttgaagaaactgttgattatgtgttgnttcatttcatcctgtgagacttgcacttgcacctgtaatgtgtagtatgggaactctgcttgtataatctgctgtgtacaccacaaagataccagctcggttttgttaaaaaa

SEQ ID NO: 4782 - DNA, 1549 bp, Solanum phureja
gcacaagcgactctcctccctccttatccttcttccaaaaacatcaactatacagagataatttttctgtggaaaatggcagggagggtagatctagacggcaatccgatcaagccgatgacgatttgcatgatcggcgccggtggcttcattggctcccacttatgcgagaagctcatgtcggaaacgccgcacacggtgctcgccgtcgacgtttacagtgataaaatcaagcatctacttgaaccgacttctctaccttggaatggaaggatacagttccacagaattaacattaagaatgattctcgccttgaaggactcatcaaaatggcagatctgactgtaaatcttgctgcgatctgcactccagctgattataatacacgtccacttgacacaatctacagcaacttcattgatgctctaccagtggttaagtactgctcagaaaatggaaagcgtctcattcacttttccacttgtgaagtgtatgggaaaaccataggtgcctttttacccgaagacagcccattgcggcaggatcctgcttattttgttctttcggaagaggcatctccatgcatttttggacctattgagaagcaaaggtggtcctatgcctgtgcaaagcaattgattgagagattgatctatgctgagggtgctgagaatggcttagaattcaccattgttaggcccttcaattggattggccccaggatggattttatacccgggatcgatggtcctagtgaaggtgttccaagagtattggcttgctttagtaataacctattaagacatgaaccactaaaactagtggacggtggacactcgcagagaaccttcatatatatcaaggatgctattgaagctgtattcctgatgattgaaaatcctgcacgggccaacggccatatctttaacgtcggcaatcctaataacgaagttactgtcaagcagctagctgaaatgatgactcaggtgtactcaaaggtgagtggagaaactcctcttgaaacacccaccgtcgatgtaagttctaaagaattttatggcgaggggtatgatgacagtgacaagcgaattccagacatgaccataatcaacagacagctcggttggaacccgaagacatccctatgggacttgcttgaatccacactcacttaccaacataggacatacgctgaggctgtcaagcaggcgatgtcaaagacaacagcaaattgaatgaagtcggagcagagctttactgtgtgtaatcttcatctactcggttcgacttcatccacgttatttattctctttgtcatcctcttcatgcaaacctataataggtgacaacagattcattatgaaattatgccttagctacaacagtttttgacgcattatagtcaaaagaagcctggagtctgctcatgattttgttgtcattatattatcattcttctgtatggaagtatgttgcatcattacacatattttccttatctattactagtataaagtataatttatttgtttgattaaattgtccttt

SEQ ID NO: 4783 - DNA, 1526 bp, Solanum tuberosum
gactctcctccctccttatccttcttccaaaaacatcaactatacagagataatttttctgtggaaaatggcagggagggtagatctagacggcaatccgatcaagccgatgacgatttgcatgatcggcgccggtggcttcattggctcccacttatgcgagaagctcatgtcggaaacgccgcacacggtgctcgccgtcgacgtttacagtgataaaatcaagcatctacttgaaccgacttctctaccttggaatggacggatacagttccacagaattaacattaagaatgattctcgccttgaaggactcatcaaaatggcagatctgactgtaaatcttgctgcgatctgcactccagctgattataatacacgtccacttgacacaatctacagcaacttcattgatgctctaccagtggttaagtactgctcagaaaatggaaagcgtctcattcacttttccacttgtgaagtgtatgggaaaaccataggtgcctttttacccgaagacagcccattgcggcaggatcctgcttattttgttctttcggaagaggcatctccatgcatttttggacctattgagaagcaaaggtggtcctatgcctgtgcaaagcaattgattgagagattgatctatgctgagggtgctgagaatggcttagaattcaccattgttaggcccttcaattggattggccccaggatggattttatacccgggatcgatggtcctagtgaaggtgttccaagagtattggcttgctttagtaataacctattaagacatgaaccactaaaactagtggacggtggacactcgcagagaaccttcatatatatcaaggatgctattgaagctgtattcctgatgattgaaaatcctgcacgggccaacggccatatctttaacgttggcaatcctaataacgaagttactgtcaagcagctagctgaaatgatgactcaggtgtactcaaaggtgagtggagaaactcctcttgaaacacccaccgtcgatgtaagttctaaagaattttatggcgaggggtatgatgacagtgacaagcgaattccagacatgaccataatcaacagacagctcggttggaacccaaagacatccctatgggacttgcttgaatccacactcacttaccaacataggacatacgctgaggctgtcaagcaggcgatgtcaaagacaacagcaaattgaatgaagtcggagcagagctttactgtgtgtaatcttcatctactcggttcgacttcatccacgttatttattctctttgtcatcctcttcatgcaaacctataataggtgacaacagattcattatgaaattatgccttagctacaacagtttttgacgcattatagtcaaaagaagcctggagtctgctcatgattttgttgtcattatattatcattctactgtaatggaagtatgttgtatcattacacatattttccttatctaattactagtataaagtataatttatttgtt

SEQ ID NO: 4784 - DNA, 1298 bp, Brassica juncea
aagctcatgaacgagactccgcacaaggtcctcgccctcgacgtctacaacgacaagatcaagcacctgctggagcctggtacttctcagtggggggagaggatccagttccatcgcatcaacatcaagcacgattcgagactcgagggactcgtcaagatggcagatctgacgatcaattttgctgcgatctgtacaccggcggattacaatacgcgtcctcttgacactatctacagcaatttcatcgatgctctccctgtggttaagtactgctcagagaacaacaagcgtcttattcacttctccacttgtgaagtctatgggaaaactattggaagctttcttccaaaggatcatcctctgcgtcaggatcctgaattttatgtactcaaagaagatacatctccttgcatttttggttctattgagaagcagaggtggtcatatgcttgtgcgaagcaactgattgagagacttgtctacgctgagggtgctgagaatggacttgagttcaccattgtaagaccgtttaactggattggacctaggatggatttcatccctggcattgatggtcctagcgagggtgtccctcgtgtcctggcgtgctttagcaacaaccttctgcgacgtgagcctctcaagcttgtggatggtggagaatcacagagaaccttcatctacatcaaagatgctattgaagctgtcctcctgatgattgaaaacccagagagagccaatgggcatatcttcaatgtaggaaacccaaacaatgaagtgacagtaaggcagcttgcggaaatgatgactaaggtctactcaaaagtgagtggagagacagctattgagagtccaactatagatgtgagctccaaagaattctatggagaaggttatgatgacagcgacaagagaatcccagacatgaccatcattaaccgtcaacttggatggaacccgaagacgtctctttgggacttgcttgagtcgaccttaacttaccagcacaggacctatgctgaagctgttaagaaggccacttcaaaaccagtcgcatcttagaggtcatcatcacctcgaaccatttggcggctactatttcctattatttttgttttcttactcaatattcccttaatataagaccacacttctctaagcgaatgatgatatcatggtggttggttctagtttatagtattactgttaatgtttttgtaattcgtcgttgaagcttgatatatctttgtatttgtcccaaaaacaaaaactaaaaaaagaagaatggtttgtta

SEQ ID NO: 4785 - DNA, 1532 bp, Solanum tuberosum
gcgactctcctccctccttttcctccttctaaaaacatcaactatacagagagaatttttctgtggaaaatggcagggaaggtagatctagacggcaatccgatcaagccgatgacgatttgcatgatcggcgccggtggcttcattggctcccacttatgcgagaagctcatgtcggaaacgccgcacacggtgctcgccgtcgacgtttacagtgataaaatcaagcatctacttgaaccgacttctctaccttggaatggacggatacagttccacagaattaacattaagaatgattctcgccttgaaggactcatcaaaatggcagatctgactgtaaatcttgctgcgatctgcactccagctgattataatacacgtccacttgacacaatctacagcaacttcattgatgctctaccagtggttaagtactgctcagaaaatggaaagcgtctcattcacttttccacttgtgaagtgtatgggaaaaccataggtgcctttttgcccgaagacagcccattgcggcaggatcctgcttattttgttctttcggaagaggcatctccatgcatttttggacctattgagaagcaaaggtggtcctatgcctgtgcaaagcaattgattgagagattgatctatgctgagggtgctgagaatggcttagaattcaccattgttaggcccttcaattggattggccccaggatggattttatacccgggatcgatggtcctagtgaaggtgttccaagagtattggcttgctttagtaataacctattaagacatgaaccactaaaactagtagacggtggacactcgcagagaaccttcatatatatcaaggatgctattgaagctgttttcctgatgattgaaaatcctgcacgggccaacggccatatctttaacgtcggcaatcctaataacgaagttactgtcaagcagctagctgaaatgatgactcaggtgtactcaaaggtgagtggagaaactcctcttgaaacacccaccgtcgatgtaagttctaaagaattttatggcgaggggtatgatgacagtgacaagcgaattccagacatgaccataatcaacagacagcttggttggaacccaaagacatccctatgggacttgcttgaatccacactcacttaccaacataggacatacgccgaggctgtcaagcaggcgatgtcaaagacaacggcaaattgaatgaagtcggagcagagctttactgtgtgtaatcttcatctactcggttcgacttcatccacgttatttattctctttgtcatcctcttcatgcaacctataataggtgacaacagattcactatgaaattaagccttagctacaacagtttttgacgcattatagtcaaaagaagcctgcagtttgctcatatgattttgttgtcattatattatcattcttctgtatggaagtatgttgtatcattacacatattttccttatctattactagtataaagtataatttatttgtttgatt

SEQ ID NO: 4786 - DNA, 1775 bp, Castanea mollissima
ccgctctttctttccccttcaaataactcttcacctctcttctcctcacattctttccttcctttccatccaaattcctctctctctttctctcagactcaactctctcagtgcacaaaaagcaaagaaaccagcaacaaagaaaagcttcaaacagagaaaaaatggcggcgagggtagatctagatgggaaaccaatcaagcctctgacgatatgcatgatcggagctggtggtttcattggctctcacctctgcgaaaagctcatggcggagacgccgcacaaggtgatggctctcgatgtctacagcgacaagatcaagcaccttctcgagcccgctggggctcacccttggtccgatcgcatccagttccaccgcctcaacatcaagaacgactctcgcctcgaaggcctcatcaagatgtcagatctgacgataaatctggctgcgatttgtactccggcggactacaacacgcgacctctcgacacgatttacagcaatttcatcgatgcgctcccagtggttaagtactgctcagagaacaataagcgtctcattcacttctctacttgtgaggtgtatgggaaaacgattgggagctttcttcctaaagacagtcctcttcgtaaggagcctgaatatttcgttcttaaagaagatgaatccccatgcatttttggccctattgagaagcagcgatggtcctatgcatgtgcaaagcagttgattgagaggctgatttatgctgaaggtgcagagaatggtctggagttcacaattgtgaggccttttaactggattggacccagaatggatttcattcctggcattgacggtccaagtgagggtgttcccagggttctggcatgctttagcaataatctactgcgtcatgaaccactcaagcttgtggatggtggtgtttcccagagaacattcgtttatataaaggatgcaattgaagctgttatgttgatgattgaaaatcccgctagagccaatggccatatttttaacgtgggcaaccctaacaatgaagttacggttaggcagcttgcagaaatgatgactgatgtttattcaaaagtaagtggtgaaccttctctggaagaacctacagttgatgtgagctcccaagaattttatggtgcgggatatgacgatagtgataagagaattcctgacatgaccataatccataaacaacttggttgggaccccaagacatcgctctgggatttacttgaatcaacactcacctatcaacacaggacatatgctgaggctatgaagcaggccattgcaaaaccagctgccaactaaagcaagttggtgttcggtggcacttaagagaagggggattgctgtttaggttgctgttgtctacaattctttttacggaagtcctataatatatgttaatctttgattcccacataccctattttttgtttttttcgcctttccggtgtcactagtcttatagctgaagtagctcagggatgtgttccggatatctctggagaagaccttagattctgttactgaactctatcgtataactgtaattttcagtagagcttttggctacgacatgttgggggccattatacaaggaaatcctggtttatgttctcaccttctcatggggtaatggttgtcatttccctattttgtcactctcagggcgggttgtattatttatttatctgtttgagtcgcaatgtgtcatgtattctaaattattattattatttattaatctcaggc

SEQ ID NO: 4787 - DNA, 1480 bp, Quercus alba
atacatcctccctccctttccgctctctcttccccccttcaaatatccctttcacctctcttctcctcacatcgttgccttccaatccaaattcctctctctctctctctcacaaactcagctctctcagtgcacaaaaagcaaagaaaccaacaacaaagaaaagcttcaaacagagaaaaatggcggcgagggtagatctggacgggaaaccaatcaagcctctgacgatatgcatgatcggagctggtggcttcattggctcccacctctgcgaaaagctcatggcggagacgccgcacaaggtgttgggtctcgatgtctacagcgacaagatcaagcaccttctcgagcccgcgggcgctcacccttggtccgatcgcatccagttccaccgcctcaacatcaagaacgactctcgcctcgaaggcctcatcaagatgtcagatctgacgataaatctggcggcgatttgtactccggcggactacaacacgcgtccactcgatacgatttacagcaatttcatcgatgcgctcccagtggttaagtactgctcagagaacaataagcgtctcattcacttctctacttgtgaggtgtacgggaaaacgattgggagctttcttcctaaagacagtcctcttcgtaaggagcctgaatattttgttcttaaagaagatgaatccccatgcatttttggccctatcgagaagcagcgatggtcctatgcatgtgcaaagcagttgattgagagactgatttatgctgaaggtgcagagaatggtatggagttcacaattgtgagaccttttaactggattggacccagaatggatttcattcctggcattgacggtccaagtgagggcgttcccagagttctggcatgctttagcaataatctactgcgtcatgagccactcaagcttgtggatggtggtgtttcccagagaacattcgtttatataaaggatgcaattgaagctgttatgttgatgattgaaaatcccgctagagccaatggccatatttttaatgtgggcaaccctaacaatgaagttacagttaggcagcttgcagaaatgatgaccgatgtttattcaaaagtaagtggtgaaccttctctggaagaacctacagttgatgtgagctcccaagaattttatggtgtgggatatgacgatagtgataagagaattcctgacatgaccatcatcaataaacaacttggttgggaccccaagacatcgctctgggatttgcttgaatcaactctcacctatcaacacaggacatacgctgaggctatgaagcaggccattgcaaaaccagctgccaactaaagcaaaatggtgtttggtggcacttaagagaagggggattcttgcttaggttgctgttgtctacaattctttttacggaagtcctataatatatgttaatctttgattcccacataccctattttttgtttttt

SEQ ID NO: 4788 - DNA, 1857 bp, Quercus alba
agaaatacatcctccctccctttccgctctctcttccccccttcaaatatccctttcacctctcttctcctcacatcctttccttccaatccaaattcctctctctctcacaaactcaactctctcagtgcacaaaaggcaaagaaaacaacaacaaagaaaagcttcaaacagagaaaaatggcggcgagggtagatctggacgggaaaccaatcaagcctctgacgatatgcatgatcggagctggtggtttcattggctcccacctctgcgaaaagctcatggcggagacgccgcacaaggtgttgggtctcgatgtctacagcgacaagatcaagcaccttctcgagcccgcgggggctcacccttggtccgatcgcatccagttccaccgcctcaacatcaagaacgactctcgcctcgaaggcctcatcaagatgtcagatctgacgataaatctggcggcgatttgtactccggcggactacaacacgcgtccactcgatacgatttacagcaatttcatcgatgcgctcccagtggttaagtactgctcagagaacaataagcgtctcattcacttctctacttgtgaggtgtacgggaaaacgattgggagctttcttcctaaagacagtcctcttcgtaaggagccagagtatttcgttcttaaagaagatgaatccccatgcatttttggccctattgagaagcagcgatggtcctatgcatgtgcaaagcagttgattgagaggctgatttatgctgaaggtgcagagaatggtatggagttcacaattgtgagaccttttaactggattggacccagaatggatttcattcctggcattgacggtccaagtgagggtgttcccagagttctggcatgctttagcaataatctactgcgtcatgaaccactcaagcttgtggatggtggtgtttcccagagaacattcgtttatataaaggatgcaattgaagctgttatgttgatgatcgaaaatcccgctagagccaatggccatattttcaatgtgggcaaccctaacaatgaagttacagttaggcagcttgctgaaatgatgactgatgtttattcaaaagtaagtggtgaaccttctctggaagaacctacagttgatgtgagctcccaagaattctacggtgctggatatgacgatagtgacaagagaattcctgacatgaccataatccataaacaacttggttgggaccccaagacatcgctctgggatttgcttgaatcaacactcacctatcaacacaggacatatgctgaggctatgaagcaggccattgcaaaaccagctgccaactaatgcaagttggtgttcggtggcacttacgagaagggggattcttgcttaggttgcttttgtctacaattctttttacggaagtcctataatatatgttaatctttgattcctacataccctatttttttgtttttttcggtctttccggtgtcactagtcttatagctgaagtagctcaggaatatgttccggatatctctggagaaggcactagattctgttaccgaactctatcgtataactgtaattgtcagtagagcttggctacgacatgttgggggccattatacaaggaaagcctgctttatgttctcaccttctcatggggtaatggttgtcattccctactttgtcactctcagggcgtattgtttgagttgcaatgtgtcatgtctcctaaattattattattattattatttattaatctcaggcaattcttttggttgctgggttctacttctatatatgtagtgtgatgagagttattgaataaaaaaataggttgttcaa

SEQ ID NO: 4789 - DNA, 1895 bp, Quercus alba
tcggggtatccactcacagaaatacatcctccctccctttccgctctctcttccccccttcaaatatccctttcacctctcttctcctcacatcctttccttccaatccaaattcctctctctctcacaaactcaactctctcagtgcacaaaaggcaaagaaaacaacaacaaagaaaagcttcaaacagagaaaaatggcggcgagggtagatctggacgggaaaccaatcaagcctctgacgatatgcatgatcggagctggtggtttcattggctcccacctctgcgaaaagctcatggcggagacgccgcacaaggtgttgggtctcgatgtctacagcgacaagatcaagcaccttctcgagcccgcgggggctcacccttggtccgatcgcatccagttccaccgcctcaacatcaagaacgactctcgcctcgaaggcctcatcaagatgtcagatctgacgataaatctggcggcgatttgtactccggcggactacaacacgcgtccactcgatacgatttacagcaatttcatcgatgcgctcccagtggttaagtactgctcagagaacaataagcgtctcattcacttctctacttgtgaggtgtacgggaaaacgattgggagctttcttcctaaagacagtcctcttcgtaaggagccagagtatttcgttcttaaagaagatgaatccccatgcatttttggccctattgagaagcagcgatggtcctatgcatgtgcaaagcagttgattgagaggctgatttatgctgaaggtgcagagaatggtatggagttcacaattgtgagaccttttaactggattggacccagaatggatttcattcctggcattgacggtccaagtgagggcgttcccagagttctggcatgctttagcaataatctactgcgtcatgagccactcaagcttgtggatggtggtgtttcccagagaacattcgtttatataaaggatgcaattgaagctgttatgttgatgatcgaaaatcccgctagagccaatggccatattttcaatgtgggcaaccctaacaatgaagttacagttaggcagcttgctgaaatgatgactgatgtttattcaaaagtaagtggtgaaccttctctggaagaacctacagttgatgtgagctcccaagaattctacggtgctggatatgacgatagtgacaagagaattcctgacatgaccataatccataaacaacttggttgggaccccaagacctcgctctgggatttgcttgaatcaacactcacctatcaacacaggacatatgctgaggctatgaagcaggccattgcaaaaccagctgccaactaatgcaagttggtgttcagtggcacttacgagaagggggattcttgcttaggttgctgttgtctacaattctttttacggaagtcctataatatatgttaatctttgattcccacataccctattttttgtttttggtctttccggtgtcactagtctcatagccgaagtagctcaggaatgtgtttcggatatctctggagaagaccttagattctgttactgaactctatcgtataactgtaattgtcagtagagcttggctacgacatgttgggggccattatacaaggtttatgttctcaccttctcatggggtaatggttgtcatttccctattttgtcactctcagggcgcgttgtattatttatttatcttgtttgagtcgtatcctaaattattattgttattatttattaatctcaggcaattcttttggttgctgggttctacttctacataagtagtgtgatgagatttattgaataaaaaaatagtttgttcaaaagttaaattaatcgcgatctagaactaga

SEQ ID NO: 4790 - DNA, 1544 bp, Solanum lycopersicum
gtcacaagcgactcaactccctcctttttttcctacttctaaaatcaactatacagagtgaatttttctgtggaaaaatggcagggagggtagatctagacggcaatccgatcaatccgatgacgatttgcatgatcggcgccggtggattcattggctcgcacttatgtgagaagctcatgtcggaaacgcagcacacggtgctcgccgtcgatgtttacagtgataaaatcaagcatctgcttgaaccgacttctctaccttggaatggacggatacagttccacagaattaacattaagaatgattctcgtcttgaaggactcatcaaaatggcagatctgactgtaaatcttgctgcaatctgcactccagctgattataatacacgtccgcttgacacaatctacagcaacttcattgatgctctaccagtggttaagtactgctcagaaaatggaaagcgtctcattcacttttccacttgtgaagtttatgggaaaaccataggtgcttttttgcccgaagacagcccattgcggcaggatcctgcttattttcttctttcggaagatgcatctccatgcatttttggacctattgagaagcaaaggtggtcctatgcctgtgcaaagcaattgattgagagattgatctatgctgagggtgctgagaatggcttagaattcaccatcgttaggcccttcaattggattggccccaggatggattttatacccgggatcgatggtcctagtgaaggtgttccaagagtattggcttgctttagtaataacctattaaggcatgaaccactaaaactagtggacggtggacactcgcagagaaccttcatatatatcaaggatgctattgaagctgtttccctgatgattgaaaatcctgctcgggccaacggccatatctttaacgtcggcaatcctaataacgaagttactgtcaagcagctagctgaaatgatgactcaggtgtactcaaaagtgagtggagaaacccctcttgaaactcccaccgtcgatgttagttctaaagaattttatggcgaggggtatgatgacagtgacaagcggattccagacatgaccataatcaacagacagctcggttggaacccaaagacatccctatgggacttgcttgaatccacactcacttaccaacataggacatacgcggaggctgtcaagcaggcgatgtcaaagacaacgacaaactgaatgaattcagagcagagctttactatctgtaatcttcatctactcggttcgacttcatcctcgttatttattctttgtcatccacttcatgcaagaaacctaaagtaggccacaacagtgaaattgtgtgtcatatgttggtataatgtcactacaacagttttcagacacataaatcaaaacaaggctgtagtctgctcatataattttgctgttatattatcattcttctgtgaggaagtatgttgtatcattacacatattttcctaatctattactagtataataatttatttgtttgatta

SEQ ID NO: 4791 - DNA, 1546 bp, Solanum tuberosum
cacaagcgactctcctccctccttatccttcttccaaaaacatcaactatacagagataatttttctgtggaaaatggcagggagggtagatctagacggcaatccgatcaagccgatgacgatttgcatgatcggctccggtggcttcattggctcccacttatgcgagaagctcatgtcggaaacgccgcacacggtgctcgccgtcgacgtttacagtgataaaatcaagcatctacttgaaccgacttctctaccttggaatggaaggatacagttccacagaattaacattaagaatgattctcgccttgaaggactcatcaaaatggcagatctgactgtaaatcttgctgcgatctgcactccagctgattataatacacgtccacttgacacaatctacagcaacttcattgatgctctaccagtggttaagtactgctcagaaaatggaaagcgtctcattcacttttccacttgtgaagtgtatgggaaaaccataggtgcctttttacccgaagacagcccattgcggcaggatcctgcttattttgttttttcggaagaggcatctccatgcatttttggacctattgagaagcaaaggtggtcctatgcctgtgcaaagcaattgattgagagattgatctatgctgagggtgctgagaatggcttagaattcaccattgttaggcccttcaattggattggccccaggatggattttatacccgggatcgatggtcctagtgaaggtgttccaagagtattggcttgctttagtaataacctattaagacatgaaccactaaaactagtggacggtggacactcgcagagaaccttcatatatatcaaggatgctattgaagctgtattcctgatgattgaaaatcctgcacgggccaacggccatatctttaacgttggcaatcctaataacgaagttactgtcaagcagctagctgaaatgatgactcaggtgtactcaaaggtgagtggagaaactcctcttgaaacacccaccgtcgatgtaagttttaaagaattttatggcgaggggtatgatgacagtgacaagcgaattccagacatgaccataatcaacagacagctcggttggaacccaaagacatccctatgggacttgcttgaatccacactcacttaccaacataggacatacgctgaggctgtcaagcaggcgatgtcaaagacaacagcaaattgaatgaagtcggagcagagctttactgtgtgtaatcttcatctactcggttcgacttcatccacgttatttattctctttgtcatcctcttcatgcaaacctataataggtgacaacagattcattatgaaattatgccttagctacaacagtttttgacgcattatagtcaaaagaagcctggagtctgctcatgattttgttgtcattatattatcattctactgtaatggaagtatgttgtatcattacacatattttccttatctaattactagtataaagtataatttatttgtttgattaaattctc

SEQ ID NO: 4792 - DNA, 1605 bp, Solanum lycopersicum
actccctcctttttttcctacttctaaaatcaactatacagagtgaatttttctgtggaaaaatggcagggagggtagatctagacggcaatccgatcaatccgatgacgatttgcatgatcggcgccggtggattcattggctcgcacttatgtgagaagctcatgtcggaaacgcagcacacggtgctcgccgtcgatgtttacagtgataaaatcaagcatctgcttgaaccgacttctctaccttggaatggacggatacagttccacagaattaacattaagaatgattctcgtcttgaaggactcatcaaaatggcagatctgactgtaaatcttgctgcaatctgcactccagctgattataatacacgtccgcttgacacaatctacagcaacttcattgatgctctaccagtggttaagtactgctcagaaaatggaaagcgtctcattcacttttccacttgtgaagtttatgggaaaaccataggtgcttttttgcccgaagacagcccattgcggcaggatcctgcttattttcttctttcggaagatgcatctccatgcatttttggacctattgagaagcaaaggtggtcctatgcctgtgcaaagcaattgattgagagattgatctatgctgagggtgctgagaatggcttagaattcaccatcgttaggcccttcaattggattggccccaggatggattttatacccgggatcgatggtcctagtgaaggtgttccaagagtattggcttgctttagtaataacctattaaggcatgaaccactaaaactagtggacggtggacactcgcagagaaccttcatatatatcaaggatgctattgaagctgtttccctgatgattgaaaatcctgctcgggccaacggccatatctttaacgtcggcaatcctaataacgaagttactgtcaagcagctagctgaaatgatgactcaggtgtactcaaaagtgagtggagaaacccctcttgaaactcccaccgtcgatgttagttctaaagaattttatggcgaggggtatgatgacagtgacaagcggattccagacatgaccataatcaacagacagctcggttggaacccaaagacatccctatgggacttgcttgaatccacactcacttaccaacataggacatacgcggaggctgtcaagcaggcgatgtcaaagacaacgacaaactgaatgaattcagagcagagctttactatctgtaatcttcatctactcggttcgacttcatcctcgttatttattctttgtcatccacttcatgcaagaaacctaaagtaggccacaacagtgaaattgtgtgtcatatgttggtataatgtcactacaacagttttcagacacataaatcaaaacaaggctgtagtctgctcatataattttgctgttatattatcattcttctgtgaggaagtatgttgtatcattacacatattttcctaatctattactagtataataatttatttgtttgattaaattatcctttcactttaatgtctttatgttaaagaatattattttttaaatactaacttttaccatagttgattt

SEQ ID NO: 4793 - DNA, 1360 bp, Liriodendron tulipifera
  misc_feature (878)..(878): n is a, c, g, or t
  misc_feature (1195)..(1195): n is a, c, g, or t
agacgccctctctctctctctctctctctctctctctaaacgaacgaacagagatcgtctctttaatggcgtcctcgagggtagatctggacggccgtccgatcaagccatttacgatctgcatgatcggagcgggtggcttcataggctcgcatctctgcgagaagctgctggcagagactgcacacaagatcctggccgtcgacgtctacaatgacaagatcaagcaccttctcgagcctagcccatccaatccaaccctaccttgggccgatcgcatccagttccaccgcatcaacatcaagcacgattctcgcctcgaaggcctcatcaagatggcagatctgactatcaatcttgcggcgatctgtactccggccgattacaacacccgccctctcgatactatatacagcaatttcattgacgcgattccagtcgttaagtattgctcagaaaacagtaagcgtctcatccatttctctacttgtgaaatttatgggaagacaatcggaagctttctccccaaggatcaccctctgcgtcaggacccttctttctatgtcctcaaagaagatgcttctccctgcatatttggtcctattgagaaacagagatggtcttatgcatgcgcgaagcaactaattgaaaggctaatttatgctgagggtgcggaaaatggtcttgaattctccattgtgagacctttcaactggattggaccaaggatggatttcatacctggtgttgatggtccaagcgagggtgttccgagggttctggcatgtttcagtaacaatctcctgcgtggtgagccacttaagcttgtagatggcggccagtcgcaaagaacctttgtttatatcaaagatgctatngaagctgttttgttgatgattgaaaatccagaaagagccaatggtcatattttcaatgtgggcaatcctaacaatgaagtcacggtgaagcaacttgcagaaatgatgacagaggtgtattcaaaggtaagtggagaacctgcattggaggtgccaactatcgatgtgagctccaaggagttttatggtgaaggatatgatgacagtgataaacgaattccagacatgactatcatcaacaagcagctcggttggaatcctaagacgtcactgtgggacctgctggaatcaacactgacttaccacacaggacatangccgaggccatcaagcagctgacttcgaagccggttgcatccagctaaaatgcagcagttttaagtaaatgtggggaggccctattcttttgaagaaaccatgtgataccgcttattcatatatgcttctggcattgggggccacttgccaatcgctgctgatag

SEQ ID NO: 4794 - DNA, 1483 bp, Ricinus communis
ctatacacatcgatcctctcttccacttcttcttcttcttaatatcacaccccctcggcgcacattagccttcaccgttacatttccgttatttttttcttgattgctgttctgcggcaatggcgaatagagtggatctcgatgggaggccaataaaggaaatgactatatgcatgatcggtgcaggaggtttcatagggtcacatctatgtgaaaagattttgaacgaaacgccgcacaagatcttggctcttgacgtctacaacgacaagatcaagcaccttcttgaaccggattctttaccttgggctggccggatccagttccaccgtattaatatcaagcatgattctcgcttggaaggccttatcaagatggcggatctgacgataaatctagctgcgatctgcacaccggcggattataatacgcgtcctttggatacgatttacagcaatttcatagatgcgctgcctgtggtaaagtactgttcagagaataacaaacgtttaattcacttctcaacttgcccgtcttatttttcctgggatcctgcttactacattcttaaagaagatgagtccccttgcatttttggttccattgagaagcagaggtggtcttatgcatgtgcaaagcaactgattgagaggctgatatatgctgagggtgcagagaatggccttgagttcaccattgtgagacctttcaattggattggacctaggatggactttattcctggcattgatggcccaagtgagggtgttcccagggtcctggcatgctttagcaatgctcttctacgtggtgagccacttaagcttgtggatggtggccaatcccagagaacttttgtttatattaaggatgccattgaagctgttctgttgatgattgaaaacccagccagagctaatggtcatatttttaatgtgggaaatcctcacaatgaagttacagtcaagcagcttgccgagatgatgacagaggtctattcaaaggtaagcggggaacctgttttggaggtgccaacagttgatatatcctcaaaagaattttatggcgagggatatgatgatagtgacaagagaattccagacatgaccataatcaataggcaacttggttggaaccccaagacatcgctatgggacttgcttgaatcaaccctcacttaccaacacaggacatatgcagaggcaattaagaaggtgcttgcaaagccaacatccagctaaggaatttagatgtttggataaggggaatatgttggatagttctgtttgttagcatgagttccaattctttgttaagggaaatcttttttaagtatctttagccgatggtaccatatacgctacagaattttttgtctttccgcagtgtcggtagctcaggaaaacaaactgtgttttgggatgacatgatgatattaagcttgagaaaatgtttaggttcttctggtagattaaaaaaagaa

SEQ ID NO: 4795 - DNA, 1435 bp, Zingiber officinale
  misc_feature (527)..(527): n is a, c, g, or t
  misc_feature (603)..(603): n is a, c, g, or t
  misc_feature (619)..(619): n is a, c, g, or t
  misc_feature (664)..(664): n is a, c, g, or t
  misc_feature (937)..(937): n is a, c, g, or t
  misc_feature (1126)..(1126): n is a, c, g, or t
  misc_feature (1156)..(1156): n is a, c, g, or t
  misc_feature (1212)..(1212): n is a, c, g, or t
  misc_feature (1259)..(1259): n is a, c, g, or t
  misc_feature (1314)..(1314): n is a, c, g, or t
  misc_feature (1332)..(1332): n is a, c, g, or t
  misc_feature (1347)..(1347): n is a, c, g, or t
  misc_feature (1350)..(1351): n is a, c, g, or t
  misc_feature (1354)..(1354): n is a, c, g, or t
  misc_feature (1356)..(1356): n is a, c, g, or t
  misc_feature (1358)..(1358): n is a, c, g, or t
  misc_feature (1361)..(1364): n is a, c, g, or t
  misc_feature (1368)..(1368): n is a, c, g, or t
caggcagtgaatcgacgccaccgaaagatctcgcaggtagagagagaaattttgagcatatcagctatggcatcggttgcgaggctggatcttgacgggaatccgatcgacccgatgacgatctgcatgattggggccgggggattcataggctcccacctgtgcgagaagctgatggccgagacgccccacacggtgctggcagtggacgtctactgcgacaagatcaagcacctactcgacccggaagaggggcaggaggcgtcgcgcggccggatccagtttccaccgcctcaatatcaagcacgattccagactggagggactcatcaagatgtcggatttaacgattaatctggcggcaatctgcactcctgcggactataacacccgtccacttgacaccatctacagcaatttcattgatgctctcccagttgtcaggtattgctcagaaaatagcaagcgtctcattcacttctcgacttgtgaagtttatgggaaaacgataggaagcttcctgcccnaggaccatcctcttagaaaggaacctgagttttttgtgctcaaggaagatgcctccccctgtatttttggttcaantgagaaacagaggtgntcttatgcttgtgcaaagcagcttattgagaggttgatttacgcngagggtgcagaaaatggtcttgagttcaccattgtgagacctttcaattggattggaccgaggatggacttcattcctgggattgatggtcctagtgagggtgttcccagggttcttgcatgcttcagtaataatctgctgcgccgtgagcctttgaaacttgttgatggcggtcaatctcaacgaacatttgtgtacatcaaggatgcaattgaagcagttctgctgatgatagaaaatcctgctcgagctaacggccacatctttaacgtnggaaatcctaacaatgaagccactgtaaaacaacttgctgagatcatgacccaggtttacgcaaaagtatcaggggagcctcctttggaggtgcctacaattgatgttagctcgagagagttctatggcgaaggatacgatgatagtgataaaagaattccggacatgacaattattaataaacagctnggttggaacccgaaaacatctctatggganttgctggattccacattgacttaccagcacaagacctatgctgaagccatcaggangtcacttgcaaagcctgctgcatccagctagatgcttgcttttcgtntctgcatatatatatatattgcagatcatatagattttgctagtgagttgctacntgccattctttctattgngacttttataaccanctnntgncnanttnnnnacgngggaagtatcagttacctaagacaggaatgtgggtcttttgacagcctataacaattgattacattt

SEQ ID NO: 4796 - DNA, 1258 bp, Cynara scolymus
  misc_feature (459)..(460): n is a, c, g, or t
  misc_feature (496)..(496): n is a, c, g, or t
  misc_feature (943)..(943): n is a, c, g, or t
  misc_feature (1210)..(1210): n is a, c, g, or t
cgggatcgatcaatccatccgttgagagagaaaaatctaagaggaaggaacttgtagccggatatttagcaatggcgacatcgtcggcaagggtagatctggacggaaacacgataaagccgttcacgatatgcatgattggtgccggaggattcattggatcgcatttgtgcgagaaattgatgtccgaaacgccgcatacagtgctggcggtggatgtttacaatgacaagatcaagcacctccttgaaccggactctcttccttgggctggtcgcatccagttccaccgacttaacattaagaacgattctcgcctcgaaggtcttatcaagtgctccgatctgacggtaaatctagccgcgatctgcacaccagcggattacaatacgcgtcctcttgacacgatttacagcaatttcttgatgcgcttcctgtggttagtactgttcagagaanncaagcggctcattcacttctcaacttgtgaagtatntgggaaaaccattggcagctatcttcccaaagatagccctttgcgacaggatcctgcttattatattcttaaagaagatacatctccttgcatttttggctcaattgagaagcagaggtggtcttatgcatgtgcaaaacagttgattgagaggctgatctatgctgagggtgcggagaatggtcttgagttcaccatagtaaggcctttcaactggattggccctaggatggattttattcccgggatcgatggtcctagcgagggtgttccaagagttcttgcatgctttagtaacaatctcctcaggcgtgagcctctgaagcttgtggatggcggtgaatcgcagagaacctttgtttatattaaggatgccattgaagctgttcttttgatgatagaaaatcctggtagagctaatggtcatatcttcaatgtgggtaaccngaacaacgaagttacagtcagacaacttgctgagatgatgaccaaggtatatgcaaaagtaagcggagaagattcaatagagagcccaaccattgatgtaagttcgaaagaattttatggtgaaggttacgatgacagtgacaagagaattccagacatgaccataataaacaaacaattaggttgggatccgaagacatcgttatgggacttgctggaatcgacccttacgtaccaacacaggacatacgcagaagcagtgaagcnatcgattgcaaaagcagtagccaactgaaaaaggaaagaaaggaaggg

SEQ ID NO: 4797 - DNA, 1471 bp, Zingiber officinale
  misc_feature (321)..(321): n is a, c, g, or t
  misc_feature (324)..(326): n is a, c, g, or t
  misc_feature (328)..(329): n is a, c, g, or t
  misc_feature (332)..(332): n is a, c, g, or t
  misc_feature (335)..(337): n is a, c, g, or t
  misc_feature (339)..(339): n is a, c, g, or t
  misc_feature (389)..(389): n is a, c, g, or t
  misc_feature (505)..(505): n is a, c, g, or t
  misc_feature (809)..(809): n is a, c, g, or t
  misc_feature (839)..(839): n is a, c, g, or t
  misc_feature (1278)..(1278): n is a, c, g, or t
  misc_feature (1396)..(1396): n is a, c, g, or t
  misc_feature (1403)..(1403): n is a, c, g, or t
  misc_feature (1437)..(1437): n is a, c, g, or t
  misc_feature (1440)..(1441): n is a, c, g, or t
  misc_feature (1446)..(1447): n is a, c, g, or t
gcacgcggttgcggaaacctaggcgacaaacaagtgccacatactgtattccctctttgacctttttctcttcgtctacggtacgattttctttgtaaaccaagggattcggagatggcagcggttgctaggctggatctcgacggaagccccatcgcgcccatgaccatctgcatgatcggggccggtgggttcatcggatcccacctctgcgagaagctgatggcggagaccccgcacacggtgctggccgtcgacgtctacaatgacaagatcaagcacctgctcgacccgccagcctacgcagaggggcagcaggcncgnnncnnatnggnnngnggatccagttccaccgcctcaacatcaagcacgattccaggctcgagggnctcatcaagatgtccgacctgacgatcaacttggcggcgatttgcacgccagcggattacaacacccgacctttagacaccatctacagcaatttcattgatgctctccccgttgncaggtactgctcagagaacagcaagcgtcttattcatttttccacctgtgaagtgtatggaaaaacaattggaagtttcctgccaaaggatcacccccttagaaaggacccagaattctatgtacttaaagaagatgcctccccttgcatttttggtcctatcgagaagcaaaggtggtcatatgcatgtgcaaagcaacttattgagagactaatatatgctgagggtgcggaaaatggtcttgagttcactattgtgaggccttttaattggattggaccgaggatggactttattcccggnatagatggtcctagtgagggtgttcctagngttttggcatgttttagcaataatcttctacgtcatgagccgctgaaacttgttgatggcggacagtcccaacgaacatttgtctatattaaagatgcgatagaggctgttctgcttatgattgaaaatcctgctcgtgctaatggtcatatctttaatgtgggaaatcctaacaatgaagtcactgtaaagcaacttgctgaaatcatgatacaggtgtattcaaaggtgtctggggaacctcctgcggaggtgcctaccattgatgtgagttccaaagagttctacggtgaaggatacgatgacagtgataagcgaattcctgacatgacaattatcaacaaacagctaggctggaacccaaagacatccctgtgggacttgctagattcaacactgacctatcaacacaggacgtatgcagaagccatcaggagancaatggcaaagtcagttgcatccagctagatgcctggaacctgatgggtttctcaaacttagtcctttttaaggtcgtatacatgtgatgggatgcactatattcttcgattagcatncattttnatttctaatgactcaaatgagcatttattaaaanaanngaaanntattcttagtcctttttaaggtcg

SEQ ID NO: 4798 - DNA, 2124 bp, Zingiber officinale
gcacgaggcaccactctcgctctctcgctctctctctctctctccgctcttccgctcctcccccgcacgcgtcggcaggaagctgaatcgaagccaccgaaagatcccgctgatcgaggaaggaatcttgagcgcatcggccatggcatcggctgcgaggctggatcttgacgggaaaccgatagaaccgatgacgatctgcatgattggggccggaggattcatcggatcccacctatgcgagaaactgatggccgagacgccccacacggtgctggcagtggacgtctacagcgacaagatcaagcacctactcgacgcggcggaggggcaagaggccgctcgccgcccttggggcggtcggatccagttccaccgcctcaatattaagaacgactccaggctcgagggcctcatcaagatgtcggatttgacgattaatctggcagcaatttgcactcctgctgattataacacccgcccactagacaccatcttcagtaatttcattgatgctctcccagttgttaagtattgctccgaaaacaacaaacgcgtcattcacttctcaacttgtgaagtgtatgggaaaacgataggaagcttcctacccaatgatcatcctcttagaaaggaacctgaattctttgtgctcaaggaagatgtgtcaccctgtatttttggtcctattgagaaacagagatggtcttatgcctgtgcaaagcaacttattgaaaggctgatttatgccgagggtgcagaaaatggtcttgagttcaccattgtgaggcctttcaattggattggaccaaggatggacttcatccctggaattgatggtcctagcgagggtgttccgagggttttggcatgcttcagtaataatttgctgcggcgtgagcctctgaaacttgttgatggcggccaatcccaacgaacatttgtgtatatcaaggatgctattgaagctgttctgcttatgatagaaaatcctgctcgagctaatggccacatctttaatgtcggaaatcctaacaatgaagtcactgtaaaacaacttgctgaaattatgacacaggtatattcaaacgtatcaggggagcccgctttggaggtgcctacgattgatgtgagttcgaaagacttctatggcgaaggatacgatgacagtgataaaagaatccctgacatgactattatcaataaacaacttggttggaacccgaagacatctctttgggacttgctggattccacgttgacctatcagcacaagacctatgctgaagccatcagaaggtccattgcaaagcctgccgcatcgcactagatgcttgcctgccagcctttcctgtctgcctttttatatattttgcagatcatatagatattgctagtgaattgttgcattgtcattttttctgttgagactttcttcactagcttatgacccataatttaattatcatggggggaattcatttacctactaagactgaatgctggaagccaagcctatataagccaatgactggtattttgttaatggaccttcatctgcctgattcttaaataaccctctacctttgtatgaaataaatcatcgtttgagactcggatttggaaaaaaaccggtgcattgcctctccccgtagatctacgcttctgctggtcgccgatctccatttgccggcgcttcactcccgtccccactgaacactggcgactctcttcctccgttacgaagctaccctccttccttcgaggttttgatttccaaatgtctggcaatgatctgattctgaaagttaatgctagctgcggcaatgaaaattcgtcttcaaatgtttcatcctggaaggacactctacttggttttgcacagcaagcatcggtttatggtgttgctgctggctattgcgtatctgcatctctgttgtccataatcaataaatgggcaatcatgaaatttccatacccaggtgctttgacagctttacaatacttcactagtgcatttggggttatgctctgtggttggttaaatctcgtggaacacgaccgtttgaacctcattactatgtggaagttcttacctgctgcaatcatgttctatctgtccct

SEQ ID NO: 4799 - DNA, 1629 bp, Cycas rumphii
gggagatctgtgtggaaaccctcggtggtgaatacattgtgatcgctcgtcgaggttgagattttgcaacgagcatctgcaatggctgtccgcgttgatctggatgggcacgagatcgaaccgatgacaatctgcatgatcggtgcgggaggtttcatcggctcgcatttgtgcgagaagctgatggccgagacgcagcacaaggttctagccatcgacgtttacagcgataaaatacagcctctgttggagcccgggctgccatgggccggccgcattgagttctatagaataaatatcaagcacgactccaggcttgagggacttatcaagatggctgatctgacgatcaatctagctgctatatgtactccagcagattacaatactcgacctcttgatactatgtatagcaatttcatggatgcgctccctgttgttcggtactgttcagaaaatggcaagcgtttgattcacttctctacatgtgaggtatatgggaagacgataggcagctttctcccaaaaggccatcctctgcggcaggatcctgccttttatgtccttaaagaggatgtgtcaccttgcatctttggccctattgagaagcaacgatggtgttatgcatgtgcaaagcagctgattgaaagggtgatttttgctgagggtgctgagaatggtttggaatttacaattgtgaggcctttcaactggattggtccaaggatggattttattccaggtattgatgggccaagtgaaggtgtaccaagggttcttgcttgctttagcaatggtctcttgcgtggtgagccgctcaaacttgtagatggtggacagtcgcaacgtacatttgtttatattaaagatgccattgaagcagttctcttgatgattgaaaacccatcaagagcaaatggtcatattttcaatgttggtaacccaaacaatgaagttactgtcaagcagttggccgaactgatgactgaggtctactctaaggtaactggacagcctcccctagacgtgccaaccattgatgtaagttcccaggaattctatggtgaaggatatgacgatagtgacaagcgaattcctgacatgacaattatcactgaacgacttggatgggaaccaaagacttccttgtcagatctgctcgaatccacccttacttatcaacataagacctattcccatgcagtgaaacagactatgtctaagtttgttgcatcaagttaaatctttgattgtaggtccagcgttatcatttttagtctatttttaagggttttgtaagtttgttatagctattcttcatagctctgcccatgtggttcaaggcatttagtgtactaggattctttgaagtttggtggtcatgtccaggagtattcagagccactgttgagtgtaggctggaatttgtattatatgttctaaattattttaaagaaaaatattagatttatttggttttagacatgttgctgaagcaaattcatttttgtttttgggaaaattttggggcactatttgattggatctatccagtaggatgggcttcacgaatgtacctgaattgctgtttttagctcatgatttgcactgttacaacagtgtttctag

SEQ ID NO: 4800 - DNA, 1197 bp, Euphorbia esula
  misc_feature (12)..(13): n is a, c, g, or t
ctttctctctcnntaacaccggcgcacattattctccaccgccgacgcagtcgttgaggtgttttccggtctcgttctttgcttgccggagagtttttttttctgtggtgatttgattcgagtgtttttcttttactgaaatggcgacggggaatagagtggatctggacggaaggccgattaagccgatgactatttgtatgattggtgccggaggtttcatcggctcgcatctctgtgagaagatattgttcgagacgcctcacaagattttggctcttgatgtctacaacgacaagatcaagcaccttcttgagccggagtgtgctacttggggtgaccggatccagttccaccgcattaacatcaagcatgattctcgcctcgaaggcctcatcaagatgtcggatctgattataaatctggcggcgatctgtacaccggcggattataatacgcgtccgttggacacgatttacagcaattttatcgatgcgctccctgtggtgaagtactgttcagagaataccaaacgcctaattcacttctccacttgtgaggtgtatggtaaaacaattggaagctttcttcctaaagacagtcctcttcgtgaggatcctgcatactacattcttaaagaagatacatctccctgcatttttggttccattgagaagcagaggtggtcgtatgcatgtgcaaagcaattgattgagaggctgatatatgctgagggtgcagagaatgggctcgagttcacaatcgtgagacccttcaactggattggacccaggatggattttattcccggcattgatggacctagtgagggtgtgcccagggttctggcctgctttagtaatgctctcttacgccgtgagccactcaagcttgtggatggtggtgaatcccagagaacatttgtttacatcaaggatgccattgatgctgttctcttaatgattgaaaatcctgctagggccaatggtcacatttttaatgttggaaaccctcacaatgaagttacagttaggcagcttgctgaaatgatgacagaggtctactctaaggtgagcaaggagcctgctctagagtctccaactgttgatgtttcctccaaggaattctatggggaggggtacgatgatagtgataagagaattccagacatgaccataatcaatagacaacttggct

SEQ ID NO: 4801 - DNA, 1586 bp, Zamia vazquezii
ggagatctctgtgcgtgaaaaagctctgtgtcggtggtgcatccagtgtgttgtgtataagtgaagaggaggggagcgagtgtgtggaaagttggaacagaggttttgcaatggcaggccgcgtcgatctggacgggaacaggatcgaaccgatgaccatctgcatgatcggtgccgggggcttcatcggctcgcatttgtgcgagaaattgatggccgagacggagcacaaggttctggcgatcgatgtttacagcgacaagatacagccgctgctggagcccgggctgccctgggcgggccgcattgagtttcatcggattaacatcaagcacgaccccaggctcgagggacttatcaagggttcggatctcacaatcaatctagctgctatttgtactccagctgattacaatacacgacctcttgataccatgtacagtaatttcatggatgctctccctgttgttaggtactgctcagaaaacaacaagcgtctgattcacttctctacctgtgaagtatatggcaagacaattggcagctttctcccaaaagaccaccctttgcggcaggatcctgccttttatgtccttaaagaggatgtatctccctgcatcttgggccctattgagaagcaacgatggtgttatgcatgtgccaagcagctgattgaaagggtgatatatgctgagggtgctgagaatggtctggaatttacaattgtgaggccttttaactggattggcccaaggatggattttatcccaggcattgatggaccgagtgaaggtgtgccaagagttcttgcttgctttagcaatggtctcttgcgaggtgagccactcaaacttgtagatgggggacagtcacaacgaacatttgtttatattaaagatgccattgaagcagttcatttgatgattgaaaacccatcaagggcaaatggtcatattttcaatgttggtaaccccaacaatgaagtgactgtaaagcagttggcggaaatgatgactgaggtctactcaaaaataactggacagcctcccttggatgtgccaaccattgatataagctctcaagaattctatggtgaaggatatgatgatagtgacaagcgaattcctgacatgacaattatccgggaacgactgggatgggaaccgaagacatccttgtgggatctgctggactccactctcacttatcaacataagacttattcccatgctgtgaaacaggctatgtctaagtctattgcatcaaattaaatctggaaatgagaggtccagcatgccatttagcctgattttaagggttttgtatgcctgttatggctattttttcataggctctacctatgtagtgcaaggcacttaatgtactaggattcttttaaatttggtggtcatgtcttcaagtagtataaactgccatcaaatataggctggaatttgtattttatatttttaattattttaaggagaaaatattagatttattttgttttagatatgttgttgaagcatattcattcattattaccaggaaatatcagtggtactatttgattggatttatccaat

SEQ ID NO: 4802 - DNA, 1394 bp, Taraxacum officinale
gcggggatcgatcaatccatccattggaggaaaatctagcaggaaggtctaagctcccggagatataggatggcggaatcgtcggcgagggtagatctggacgggaataccataaatccgatgacgatttgcatgattggtgccggtggattcataggttcacacttgtgcgagaaattgctgtcggagacgccgcacactattttagcggtagacgtgtacaatgacaagatcaaacaccttctcgagccggattcccttccttgggccggtcgcatccagttccaccgcctcaacattaagaatgattcgcgccttgaagggctcatcaagtgctccgatctgatagtaaatctcgccgcgatctgcacaccggcggactacaatacgcgtccccttgacactatttacagcaattccatcgacgcgctccctgtggttaagtactgttcggacaataacaagcgcctcattcacttctcgacttgtgaaatatatgggaaaaccatcggcagctatcttcccaaagacagccccttacgacaggatcccgcttactatatccttaaagaagatacatccccttgcattttcggtccaattgagaaacagaggtggtcgtatgcatgtgcaaaacaattgatcgagaggctaatctttgccgagggagctgaaaatggtctcgagttcaccattgttagacctttcaactggatcggccctagaatggatttcatcccagggattgatggtcccagtgaaggtgttccaagggttctcgcttgctttagtaacaatctcctcaggcgtgagcctctaaagctggtcgatggtggtgaatctcagaggacttttgtttacatcaaagatgccattgaagctgttcttttgatgattgaaaatcctggtagagctaatggacatatcttcaatgttggtaaccctaacaatgaagttacagtcaggcaacttgctgaaatgatgaccaaggtgtattcaaaagtaagcggtgaagattcaatagaaacaccaaccatcgatgttagttcaaaagagttttatggcgaaggttatgatgacagtgacaaaagaattccagacatgaccattatcaacacaggacttacgctgaggcagtgaggcaggcgattgcaaaaccagtagccagttagttactggtatgtgtttggttttttttagaatttttttttctgtataatgtaatgttgttatgtgctcaaaatattgggttttgctttttgtttttcagcaagtgtcgtattcttttattaggtctgggatattgtcataatttattaatttattgttacatgtggttgtcacatactttattaaaaaaaatataaaagtattatattttagaaaaaaaaaaa

SEQ ID NO: 4803 - DNA, 1560 bp, Carica papaya
ggcggagactcagcacaaggtgctagccctcgatgtttacaatgacaagatcaagcacctccttgagccttcttcattgccttgggccgatcggatccagttccaccgcctcaacatcaagcacgactccaggcttgaaggtctcattaagatggcagatctgacaataaatcttgcggcgatctgtacccctgcggattataatactcgtccccttgacacgatttacagcaatttcatcgatgcactccctgtggttaagtattgttcagagaacaacaagcgtctaattcacttctccacatgtgaagtgtatgggaaaactgtcggtagctttcttcctaaagatcatcccctccgtcaggatcctgcttactacgttcttaaagaagatgaatccccttgcatttttggttccattgagaagcagaggtggtcatatgcttgtgcaaagcaattgatcgagaggctcatttttgctgagggtgcagagaatggccttgaatttaccattgtgaggcccttcaactggattggacccaggatggatttcattccaggggttgatggtccaagtgagggtgttccaagagttcttgcatgctttagtaataatctcctacgccgtctgcctctcaagcttgttgatggtggacaatcacagaggactttcgtttacataaaagatgctattgaagctgttcacctgatgattgaaaacccgtccagggctaatggccatatcttcaatgtgggcaatccgaacaatgaagttacagtaaggcagcttgctgaaatgatgactcaggtctactccaaggttagtggagatcctgctctggattctccaacaattgatgtcagctcaaaagaattctatggcgagggctatgatgatagtgacaaaagaattccagacatgacgataataaatagacaacttgggtggaaccccaagacatcactctgggacttgcttgaatcaaccctcacttaccagcacaggacttacgcggaggctatcaagcaggttatatcaaagccagctaccaactaaggaggtgtagtagttgggattggcccatttaaatgagattctcacttaaatgtgcttgctagtggatgtttccaattctttcgaaggaaaagtttaaatatatcttaatggtcgttttgcatatacactacattttttctttgtcgtctttctaatattggtagtcaatagctctctgtagctcagcaagaaaattgtgttggaaaactaccctatcttgagaagacattaggggaaagatatattgttactgtaatctgtgagcaggaggttgggctacaaaatgttgggagcatttatacaaggaaagctgtttttgttgccttgggggtttgattctcatacctcttctttggtctgtgctggggtgtgttgtattagtttgatttaaccctctcagcagcatgttctttttcataatttattattatttattaattttatgcatactttctcccattggcatctctttgtctttttataactaaatgttataaattttg

SEQ ID NO: 4804 - DNA, 1509 bp, Brassica napus
tcagttccaatggctgataacaccgataaccggagagcaatatggggagttccggagaagcttcagctccacatagcgatgctcacgttacaattcggttacgcaggattccacgtggtctcgagagctgctcttaacatgggaatcagcaaacttgtcttccctgtttaccgtaacatcatcgccttgcttcttctccttcccttcgcttacttcctcgaaaagaaagagagaccagcgattactctcaactttctcatccagttcttctttttggcactcatcggaataacagcgaaccaagggttttacttgttgggtctggactacacttcaccaacgtttgcttcttccatgcaaaactctgttcccgccatcacctttctcatggctgctcttctcaggattgagaaagttagaataaacagaagagacggtatctccaaagtcttaggaacagcactttgcgttgccggagcttctgtcatcactctctacaagggtcccaccatctatacaccgactagcaacctccacgctcacctcctcaccaccaactccgccgcctccgccgtcttagcgccccttggagacgcggcgccgaaaaactggactctaggctgcatctacctgattggtcactgtctttcgtggtctggctggctcgtttttcaagctccggttcttaaatcttatccggcgaggctctcggttacgtcttacacccttttgttcggaatcatccagttcgtgatcatcgctgctttctgcgaaagagattctcaggcttgggtttttcactccggttgggagcttttcaccatcctctacgcaggaatagtggcgtctggaatcgcgtttgcggttcagatttggtgtattgacagagggggtccagtcttcgttgctgtttaccaacctgttcagactttggttgttgccataatggcttcgattgctttaggcgaggagttttacttgggcggtattattggagctgtgctgattatagcgggactttactttgtgttgtacggtaagagcgaagagaggaagtttgccgctcttgagaaggcggcgatccagtcctccgcggagcatggtatagagcgtgcccccgtttctcgcggctccatcacaactccactgctccatcagtcaacgaacaacgtttgactaatggagtattcctcaataattacaaatgccattacctaattaaaagggggaacaatggtgtgccgttgtgttttatgacttttgtgtctgcttttttctttattttagtttttttttcttaatatttgattacctacgaaaggtttttgagggggaaaatggtggatgagacatcattgttcatgaggatggtggtgatgatgatgttgatgatagtgatgatgaagactatgggaactttggactgggacttttcaatattattatatttggctgaaatatttatgccttttattacatttcttgtggtttttcttggcttttctatca

SEQ ID NO: 4805 - DNA, 1551 bp, Brassica napus
tcgtcgttcgattcaaaaatcagttccaatggctgataacaccgataaccggagagcaatatggggagttccggagaagcttcagctccacatagcgatgctcacgttacaattcggttacgcaggattccacgtggtctcgagagctgctcttaacatgggaatcagcaaacttgtcttccctgtttaccgtaacatcatcgccttgcttcttctccttcccttcgcttacttcctcgaaaagaaagagagaccagcgattactctcaactttctcatccagttcttctttttggcactcatcggaataacagcgaaccaagggttttacttgttgggtctggactacacttcaccaacgtttgcttcttccatgcaaaactctgttcccgccatcacctttctcatggctgctcttctcaggattgagaaagttagaataaacagaagagacggtatctccaaagtcttaggaacagcactttgcgttgccggagcttctgtcatcactctctacaagggtcccaccatctatacaccgactagcaacctccacgctcacctcctcaccaccaactccgccgcctccgccgtcttagcgccccttggagacgcggcgccgaaaaactggactctaggctgcatctacctgattggtcactgtctttcgtggtctggctggctcgtttttcaagctccggttcttaaatcttatccggcgaggctctcggttacgtcttacacccttttgttcggaatcatccagttcgtgatcatcgctgctttctgcgaaagagattctcaggcttgggtttttcactccggttgggagcttttcaccatcctctacgcaggaatagtggcgtctggaatcgcgtttgcggttcagatttggtgtattgacagagggggtccagtcttcgttgctgtttaccaacctgttcagactttggttgttgccataatggcttcgattgctttaggcgaggagttttacttgggcggtattattggagctgtgctgattatagcgggactttactttgtgttgtacggtaagagcgaagagaggaagtttgccgctcttgagaaggcggcgatccagtcctccgcggagcatggtatagagcgtgcccccgtttctcgcggctccatcacaactccactgctccatcagtcaacgaacaacgtttgactaatggagtattcctcaataattacaaatgccattacctaattaaaagggggaacaatggtgtgccgttgtgttttatgacttttgtgtctgcttttttctttattttagtttttttttcttaatatttgattacctacgaaaggtttttgagggggaaaatggtggatgagacatcattgttcatgaggatggtggtgatgatgatgttgatgatagtgatgatgaagactatgggaactttggactgggacttttcaatattattatatttggctgaaatatttatgccttttattacatttcttgtggtttttcttggcttttctatcatcaatagaatgttataatttgca

SEQ ID NO: 4806 - DNA, 1571 bp, Raphanus sativus
  misc_feature (1018)..(1018): n is a, c, g, or t
aatcaaacacactcattccttctccatcgtcgtctgattcaaaagtcagttccaatggctgataacaccgataaccggagagcgatatggggagttccggagaagcttcagcttcacatagcgatgctcacgttgcagttcggttacgctggattccatgtggtctcgagagctgctcttaacatgggaatcagcaaactcgtcttccctgtttatcgtaacatcattgccttgcttcttctccttcccttcgcttacttccttgaaaagaaggagagaccagcgattacactcaattttctcattcagttcttctttctggcactcatcggaataacagcgaaccaaggcttttacttgttgggactggactacacttcaccaacatttgcttcttccatgcaaaactctgttcccgccattacctttctcatggctgctcttctcaggattgagaaagttagaataaacagaagagacggtatctccaaagtcttaggaacagctctttgcgtcgccggagcttccgtcatcactctctacaagggtcccaccatctacactccgactagccacctccacactcacctcctcacaaccaaccccgccgtactagcgcctcttggagacgccgcgccgaaaactggactcttggctgcatctacctaatagtcactgtctttcgtggtctggctggctcgtttttcaagctccggttcttaaatcttatccggccaggctctcggttacgtcttacacccttttgttcggaattatccagttcgtgatcatcgctgctttctgtgaaagagattctcaggcttgggtttttcactccggttgggagcttttcaccatcctctacgcaggaatagtggcgtctggaatcgcgtttgcggttcagatttggtgtattgacagagggggtccagttttcgttgcggtttaccaacctgttcagactttggtcgttgcgattatggcttcgattgcgttaggcgaagagttttacttgggngggattattggagctgtgctgatcatagcgggactctactttgtgttgtatggtaagagcgaagagaggaagtttgcagctcttgagaaggcaatgatccagtcctccgcggagcatgttatcgagcgtgcacccgtttctcgcggctccatcaagtcgtccatcacagctccactgctccatcagtcaacggacaacgtttgacttatcgagtctctctatcaaataattacaacgccattacccaatggtgtgccgttgtgtgtttatgacttttgtgtctgctttttttttagttttttttcttaatatgttgcctaagaaaagtcgtttttgaggagggaaaagaggtagatgagacatcattgttcatgaggatggtggtgaagatgacaatgataatgatggtgatgatgaagactatgtggaagcttggattttggacctttcagtactattatatttggctgatatattagtgcccttgtattacatttcttgtggtttttatttcgcttttctatcatcaatagaatgttataatttgcattta

SEQ ID NO: 4807 - DNA, 1573 bp, Brassica napus
aatcaaacacattcattccttctccatcgtcgtctgattcaaaggtcagttccaatggctgataacaccgaccggagagcgatatggggagttccggagaagcttcagcttcacatagcgatgctcacgttgcagttcggttacgctggattccatgtggtctcgagagctgctcttaacatgggaatcagcaaactcgtcttccctgtttatcgtaacatcattgccttgcttcttctccttcccttcgcttacttcctcgaaaagaaggagagaccagcgattacactcaattttctcattcagttcttctttctggcactcatcggaataacagcgaaccaagcgttttacttgttgggactggactacacttcaccaacatttgcttcttccatgcaaaattctgttcccgccattacctttctcatggctgctcttctcaggattgagaaagttagaataaaccgaagagacggtatctccaaggtcttaggaacagctctttgcgtcgctggagcttccgtcatcactctctacaagggtccaacaatctatactccgactagccacctccacgctcacctcctcaccaccaactccgctatcttagcgccgcttggagacgccgcgccaaaaaattggactcttggctgcctctacctaataggtcactgtctctcgtggtccggctggctcgtgtttcaagctccggttcttaaatcttatccggcgaggctctcggttacgtcttacacccttttgttcggaatcatccagttcgtgatcatcgctgctttctgtgaaagagattctcaggcttgggtttttcactccggttgggagcttttcaccatcctctacgcaggaatagtggcgtctggaatcgcgtttgcggttcagatttggtgtattgacagagggggtccagttttcgttgcggtttaccaacctgttcagactttggtcgttgcgattatggcttcgattgcgttaggcgaagagttttacttgggcgggattattggagctgtgctgatcatagcgggactctactttgtgttgtatggtaaaagtgaagagaggaaatttgcagctcttgagaaggcaatgatccatgcggagcatgttatcgagcgtgcacccgtttctcgcggctccgtcaagtcgtccatcacagctccactgctccatcagtcaacggacaacgtttgacttgtcgagtctctctctatctaataattacaacgccattacccagtggtgtgccgttgtgttttatgacttttgtgtctgctttttttttttagtttttttcttaatattaattacctaagaaaggtttttgaggagggaaaagaagtagatgagacatcattgttcatgaggatggtggtgaagatgacaatcatcctgatggtgatgatgaagactatgtggaagcttggcttttggacctttcaatatattatattatgctgttatattagtgccactttgttacatttcttgtggtttttatttcgcttttctatcatcaaaagaatgttataatttgcaaaaaagggggggc

SEQ ID NO: 4808 - DNA, 1560 bp, Brassica napus
  misc_feature (969)..(969): n is a, c, g, or t
aatcaaacacattcattccttctccatcgtcgtctgattcaaaggtcagttccaatggctgataacaccgaccggagagcgatatggggagttccggagaagcttcagcttcacatagcgatgctcacgttgcagttcggttacgctggattccatgtggtctcgagagctgctcttaacatgggaatcagcaaactcgtcttccctgtttatcgtaacatcattgccttgcttcttctccttcccttcgcttacttcctcgaaaagaaggagagaccagcgattacactcaattttctcattcagttcttctttctggcactcatcggaataacagcgaaccaagcgttttacttgttgggactggactacacttcaccaacatttgcttcttccatgcaaaattctgttcccgccattacctttctcatggctgctcttctcaggattgagaaagttagaataaaccgaagagacggtatctccaaggtcttaggaacagctctttgcgtcgctggagcttccgtcatcactctctacaagggtccaacaatctatactccgactagccacctccacgctcacctcctcaccaccaactccgctatcttagcgccgcttggagacgccgcgccaaaaaattggactcttggctgcctctacctaataggtcactgtctctcgtggtccggctggctcgtgtttcaagctccggttcttaaatcttatccggcgaggctctcggttacgtcttacacccttttgttcggaatcatccagttcgtgatcatcgctgctttctgtgaaagagattctcaggcttgggtttttcactccggttgggagcttttcaccatcctctacgcaggaatagtggcgtctggaatcgcgtttgcggttcagatttggtgtattgacagagggggtccagttttcgttgcggtttaccaacctgttcagactttggtngttgcgattatggcttcgattgcgttaggcgaagagttttacttgggcgggattattggagctgtgctgatcatagcgggactctactttgtgttgtatggtaaaagtgaagagaggaaatttgcagctcttgagaaggcaatgatccatgcggagcatgttatcgagcgtgcacccgtttctcgcggctccgtcaagtcgtccatcacagctccactgctccatcagtcaacggacaacgtttgacttgtcgagtctctctctatctaataattacaacgccattacccagtggtgtgccgttgtgttttatgacttttgtgtctgctttttttttttagtttttttcttaatattaattacctaagaaaggtttttgaggagggaaaagaagtagatgagacatcattgttcatgaggatggtggtgaagatgacaatcatcctgatggtgatgatgaagactatgtggaagcttggcttttggacctttcaatatattatattatgctgttatattagtgccactttgttacatttcttgtggtttttatttcgcttttctatcatcaaaagaatgttataatttgca

SEQ ID NO: 4809 - DNA, 1358 bp, Brassica rapa
  misc_feature (68)..(68): n is a, c, g, or t
caaaggtcagttccaatggctgataacaccgaccggagagcgatatggggagttccggagaagcttcngcttcacatagcgatgctcacgttgcagttcggttacgctggattccatgtggtctcgagagctgctcttaacatgggaatcagcaaactcgtcttccctgtttatcgtaacatcattgccttgcttcttctccttcccttcgcttacttcctcgaaaagaaggagagaccagcgattacactcaattttctcattcagttcttctttctggcactcatcggaataacagcgaaccaagcgttttacttgttgggactggactacacttcaccaacatttgcttcttccatgcaaaattctgttcccgccattacctttctcatggctgctcttctcaggattgagaaagttagaataaaccgaagagacggtatctccaaggtcttaggaacagctctttgcgtcgctggagcttccgtcatcactctctacaagggtccaacaatctatactccgactagccacctccacgctcacctcctcaccaccaactccgctatcttagcgccgcttggagacgccgcgccaaaaaattggactcttggctgcctctacctaataggtcactgtctctcgtggtccggctggctcgtgtttcaagctccggttcttaaatcttatccggcgaggctctcggttacgtcttacacccttttgttcggaatcatccagttcgtgatcatcgctgctttctgtgaaagagattctcaggcttgggtttttcactccggttgggagcttttcaccatcctctacgcaggaatagtggcgtctggaatcgcgtttgcggttcagatttggtgtattgacagagggggtccagttttcgttgcggtttaccaacctgttcagactttggtcgttgcgattatggcttcgattgcgttaggcgaagagttttacttgggcgggattattggagctgtgctgatcatagcgggactctactttgtgttgtatggtaaaagtgaagagaggaaatttgcagctcttgagaaggcaatgatccatgcggagcatgttatcgagcgtgcacccgtttctcgcggctccgtcaagtcgtccatcacagctccactgctccatcagtcaacggacaacgtttgacttgtcgagtctctctctatctaataattacaacgccattacccagtggtgtgccgttgtgttttatgacttttgtgtctgcttttttttttagtttttttcttaatattaattacctaagaaaggtttttgaggagggaaaagaagtagatgagacatcattgttcatgaggatggtggtg

SEQ ID NO: 4810 - DNA, 1581 bp, Raphanus sativus
aatcaaacacactcattcattctccatcgtcgtcggatacaacggtctgttccaatggcggataacactgataaccggagagcgatatggggagttccggagaagcttcagcttcacatagccatgctcacgttacaattcggttacgctggattccacgtggtctcgagagctgctctaaatatgggaatcagcaaactcgtctttcctgtttatcgtaacatcatcgccttgcttcttctccttccctttgcttacttcctcgaaaagaaggagagaccagcgattactctaaactttctcatccagttcttctttttggcactcatcggaataacagcgaaccaagggttttacttgttgggactggacaacacttcaccaacatttgcttcttccatgcaaaactctgtcccagccattacctttctcatggctgctcttctcaggattgagaaagttagaataaacagaagagacggtatctccaaagtcttaggaacagctctttgcgtagccggagcttccgtcatcactctctacaagggtccaaccatctacactcccactagccacctccacgcccaccttctcaccaccaacccagccgtactagcgccgcttggagacgccgcgccgaaaactggactcttggttgcctctacctaattggtcactgtctctcctggtccggttggctcgtgtttcaagctccgttctaaaatcatacccggcaggctctcggtacgtcgtacacccttttgtcggatcatccagttcgtgatcatcgctgctttcttgaaagagatctcaggcttgggttttcactctggctgggagcttttcaccatcctatacgccggaatagtggcgtctggaatcgcgtttgcggttcagatttggtgtattgacagagggggtccagtgtttgttgctgtttaccaacctgttcagactttggtcgttgcgattatggcttcgattgctttaggcgaggaattttacttgggcgggattattggtgctgtgctgatcatagcgggactttactttgtgctatacggtaagagtgaagagaggaaatttgcagctcttgagaaggcagagatccagtccatcgcggagcatggtatcgagcgagtacccgtttctcgcggctccatcaagtcgtccatcacagctccactgctccataagtcaacggacaacgtttgacttgttcagggtctctccagctaataataattacaaacgccattacccatttaaaagggaacaagaatggtgtgccgttgtgttttatgacttttgtgtctgcttttttctttactttttattttattttaatattaatcacctaagcaaggtttttgagggggaagaaaagaagcggatgagacatcattgttcatgaggatagtagtgaagatgacgatgatgatgaagaatatgtgggggcttggatagggacttcaatatatgttatatttggctgataattagtgcccttttgttacatttcttgtggtttttggcttctatatcatcaatagaatgttataatttgcatttatggttcca

SEQ ID NO: 4811 - DNA, 1775 bp, Brassica napus
  misc_feature (30)..(30): n is a, c, g, or t
  misc_feature (39)..(39): n is a, c, g, or t
  misc_feature (1775)..(1775): n is a, c, g, or t
ggaatcctgctggctgtatattcacaccanatcggccangcacgccggcgtgagcttggatcctttagagcggccgccttcgacctagaactagcatttgtttaaaaatggcgatgataggcttacttgaagtcttcgtagcgttcctttttttcctagtattcaaacatttcttcctccacaagaaatctcccggccagcctattctcaaaagctggcctgtcctcgggatgcttccaggaatgctcccccatatccctcgtatcttcgactggacgttcgaggttcttgaggccaccaacctaactttctttttcaaagggccatggtttagtggaacggacatgctattcacggcggacccaagaaatatccatcacatactaagcttaaactttgggaattaccccaaaggaccagagttcaagaagatcttcgatgttttgggagacggaatcttaagtgctgatctggagctgtgggaggatctgaggaagtcaaatcacgccatctttcatcatccagatttcttgaagctctcagcaagtagcaatacaatcaagttaaaggaaggtcttgttccttttcttgataatgctgctcatgaaaacattgtcatagacttacaagatgtattcaagagattcatgtttgatacttcttcgatttcgttgactggttacgacccaatgtcactatccaccgagatgcccgaagttgagtacggtgaagctacggaaacgggtgaagaagcgatctattatagacatttcaaaccggtcatcttgtggaggcttcaaaactggttgggtattggactcgagaggaagatgaagtcttccttggtgactgtcaaccgtatgtttgcgaagatcatatccacaagaagagaggagataagtcgcggcgaaggcgagcaattaatggacgcgctaacgtattatataaatgtggacacgacaaaatataagctcttgaaacctagtaatgatacgtttatacgagacgttgctttcagtttattgttggcaggaagggacacaacaagttcagttctcacttggttcttctggcttctttctaagcatcctcatgtaatgaccaaaatccgacaagagatcaacacaaagtttgatccgacagatctagagaagctcgtgtatctacatgctacgttgaacgaaacaatgagactttacccaccggttcccttcaaccacaagtctcctttaaagtcagatgtgcttccaagcggccacaaagttaaagcagaatcaaagattgtgatctgtatctacgcattgggtagaatgagatctgtatggggagaagacgcattggattttaaaccggagagatggatttcagaaagtggagagctaaaacatgaaccttcatacaagttcatggcttttaatgctggtccgagagcttgcttgggtaaacatttggctctcccgcagatgaaaatagtagctgtagagatcatacaaaactatgactttaaggtcactgaaggtcacaagattgaagcagtgccttctatcgttctccgtatgaaaaatggtcttagtgtcacagtcactaagaagatgtgattcttattgataattggattactagtatttatgtgtttgttcggcgcaaatgtcatctaaagtattatttgtagttgtgttatttgtattatttataagtgtgtctctatttctattactatgtttgttccccgcaaatatgattttaaaaatattaaataaaatataaaatttatn

SEQ ID NO: 4812 - DNA, 1620 bp, Brassica napus
ggcttacttgaagtcttcgtagcgttcctttttttcctagtattcaaacatttcttcctccacaagaaatctcccggccagcctattctcaaaagctggcctgtcctcgggatgcttccaggaatgctcccccatatccctcgtatcttcgactggacgttcgaggttcttgaggccaccaacctaactttctttttcaaagggccatggtttagtggaacggacatgctattcacggcggacccaagaaatatccatcacatactaagcttaaactttgggaattaccccaaaggaccagagttcaagaagatcttcgatgttttgggagacggaatcttaagtgctgatctggagctgtgggaggatctgaggaagtcaaatcacgccatctttcatcatccagatttcttgaagctctcagcaagtagcaatacaatcaagttaaaggaaggtcttgttccttttcttgataatgctgctcatgaaaacattgtcatagacttacaagatgtattcaagagattcatgtttgatacttcttcgatttcgttgactggttacgacccaatgtcactatccaccgagatgcccgaagttgagtacggtgaagctacggaaacgggtgaagaagcgatctattatagacatttcaaaccggtcatcttgtggaggcttcaaaactggttgggtattggactcgagaggaagatgaagtcttccttggtgactgtcaaccgtatgtttgcgaagatcatatccacaagaagagaggagataagtcgcggcgaaggcgagcaattaatggacgcgctaacgtattatataaatgtggacacgacaaaatataagctcttgaaacctagtaatgatacgtttatacgagacgttgctttcagtttattgttggcaggaagggacacgacaagttcagttctcacttggttcttctggcttctttctaagcatcctcatgtactgaccaaaatccgacaagagatcaacacaaagtttgatccgacatatctagagaagctcgtgtatctacatgctgcgttgtacgaaacaatgagactttacccaccggttcccttcaaccacaagtctcctttaaagtccgatgtgcttccaagcgggcacaaagttaaagcagaatcaaagattgtgatatgtatctacgcattgggtagaatgagatctgtatggggagaagacgcattggattttaaaccggagagatggatttcagaaagtggagagctaaaacatgaaccttcatacaagttcatggcttttaatgctggtccaagagcttgcttgggtaaacatttggctctccagcagatgaaaatagtagctgtagagctcatacaaaactatgactttaagttcactgaaggtcacaagattgaagcagtgccttctatcgttctccgtatcaaaaatggtcttagtgtcacagtcactaagaagatgtgattcttattgataattggattacaaatatttatgtgtttgttcggcgcaaatgtcatctaaagtattatttatagttgtgttatttgtattatttataagtgtgtctctttttctattactatgtttgttccccgcaaatat

SEQ ID NO: 4813 - DNA, 1611 bp, Arabidopsis lyrata
ctatctatactcgtaaatactttgtctaaaaatggcgatgctaggtttacttgaactcttcgtagcattccttttttctcttgtatttctttttacttgtttcttcatccacaagaaacctcacggtcagcctattctcaagaactggccgttcctcgggatgcttccaggaatgctcccccaaatccctcgtatttacgactggactgtcgaggtgcttgaggcgagcaatctaaccttttatttcaaagggccatggcttagtggaacggacatgttgttcaccgcggatccaaagaatatcaatcacatactaagctcaaactttgggaattaccctaaaggacctgagttcaagaaaatctttgatgttttgggagagggaatcttaaccgttgatctggagttgtgggaggatctgaggaagtcaaatcacgccatgtttcacaatcaagatttcctcgagctctcactaagtagcaacaaaagtaagttaaaggaaggtcttgttccttttcttgataatgctgctcatgaaaacattatcatagatttacaagatgtgttcatgagattcatgtttgatacttcttcaattttgatgactggttatgatccaatgtcactatccatcgaaatgctggaagttgagttcggtgaagctgcggatattggcgaagaagcaatctactatagacatttcaaaccggtgatgttgtggaggcttcaaaactggcttggtattggacttgagaggaagatgagaacagctttggccacggtcaatcgtatgtttgcaaagatcatatcttcaagaagaaaagaggagataagtcgtggggaaaccgagccatccaaggacgcgttgacgtattatatgaatgtggacacgaccaaatataagctcttgaaaccgaaaaatgatacgtttataagagatgttatttttagtctagtgttagcaggaagggacaccacaagctcagctctcacttggttcttttggcttctttctaagaatcctcaagttatggccaagatcagacatgagatcaacacaaagtatgatcctgaagatctagagaagctcgtgtatctgcatgctgcattgtccgaatcaatgagactctacccgccacttcccttcaaccacaaggctcctgcaaagccagatgtgcttccaagcgggcacaaagttgaaccagaatcaaagatcgtgatttgtatttacgccttggggaggatgagatctgtatggggagaagatgcatcggatttcaaaccagagagatggatttcagacaatggaggtctaagacatgaaccttcatacaagtacgtggcgtttaattctggtccgagaacttgcttgggtaaacatctagctctcttgcagatgaagatagtagctctggagatcataaaaaactatgactttaaggtcattgaaggtcacaagatcgaagcaattccttctatccttctccgtatgaaacatggtcttaaagtcacagtcactaagaagatgtgattattatgcttgcttggcttctacggtaactattactacttgtattacgtactaggtgtttgtccaacgtcatgctcata

SEQ ID NO: 4814 - DNA, 1228 bp, Brassica oleracea
  misc_feature (330)..(330): n is a, c, g, or t
  misc_feature (394)..(394): n is a, c, g, or t
  misc_feature (1174)..(1174): n is a, c, g, or t
  misc_feature (1184)..(1184): n is a, c, g, or t
cgtccgagctttttgatacatatattatcttgaagctttgtcatgtcgtacgagaaagagctagccgctgcaaagaaagctgttgctctagctgctcgtctcagccgaggagtacaaaagactctgatgcaatcagaagtatggacaaaatctaacaaaactcctgtcactgcagctgattatggatcacaagctgttgttagtattgtattagagagggagctcaaacctgtaaccttgtcactagtagcagaagaggatactggagatctgcggaagaagggaagtgaggtgtttctagaaggcataacaaagcttgtgagagatacnctagcttctgatgaatcatacgcggactctcctataaccaaagaggatgtgttgaatgctatanactgtggtaaatcacaaggaggtagcactggttgccactgggttcttgatcctattgatggaaccagaggatttgtaagaggagagcaatacgctgtgggattagccttgcttgtggaaggcaaagtggtggtcggcgttatggcttgtcctaatcttcatttgtcttctgcggttgttgagaaagacgacaagtcttgccaggataatgttggatgtcttttctttgctacaactggttcaggagcttatgtgcaaccgctcaatggcaattctccaccacaggaggtgagagtgagtagcaatgagaatcttgaagaagcaaagttcttagagtcataccatatgccaattcccctccatagttccattgctaagaaacttgggatcacggcgttacctgtaaggatcgatagccaagcaaagtatgcagctgtgtccagaggagatgcggagatgtacttgcgcttcactcttgctggataccgtgagtggatatgggaccatgcagctggttcaatcatcacaacagaagctggaggcgtcgtttgcgatgctgaagggacacctctggacttctcaaaaggaaaacgtcttgatcacaacagagggatcatagttaccaccaagaaactcaagccattgattttgaaagctgttagagaatccatggaagaggagaatcttcgtgtctgagactgagacacaactgagaatctactgtatttgtatgtgtatttgtctgaactggtaactggtgtgtgtcagtgtgtgtattatngcctagttcnttgtattgtctacgtcagatatgtaatatatttgtgcttgcagg

SEQ ID NO: 4815 - DNA, 1206 bp, Brassica rapa
atatatgtaacaaacgtctatgtattggtgcactaaaaactatatagtctaaggatatatatatatattcttggagctttgtaatgtcttacgagaaggagctaggcgctgcaaagaaagctgtttctctagctgctcgtctcagccaaggagttcagaagactctcttgcaatccgaagtatggacaaaatccgacaaaactcctgtcactgcagctgattatggatcacaagctgttgttagtcttgtgttagagagggagctcaaacctgcaaccctgtcattagtagcagaagaggtggatactagagatctacggaagaaaggaagtgaggagtttctagaagatataacaaagcttgtgagagatactctagcttctgatgaatcatacgcaggctcttctataaccacagaggatgtgttgaatgccatagactgtggtaaatcacaaggaggaagcagtggttgtcactgggttcttgatcctatagatggaaccagaggatttgtaagaggagagcaatacgctgtgggattagcgttgcttgtggaaggcaaagtggtggtcggcgttatggcttgtcctaatcttcctttgtcttctgcggttgttgagaaagacgacaagtcttgccaggataatgttggatgtcttttctttgctgcaactggttcaggagcttatgtgcaaccgctcaatggcaattctccaccacaggaggtgagagtgagtagcaatgagaatcttgaagaagcaaagttcttagaatcataccatatgccaattcccctccatagttccattgctaagaaacttgggatcacagcgttacctgtaagaatcgatagccaagcaaagtatgcagctgtgtccagaggagatgcagagatgtacttgcgcttcactcttgttggataccgtgagtggatatgggaccatgcagctggttcaatcatcacaacagaagctggaggcgtcgtttgcgatgttgaagggacacctctggacttttcaaaaggaaagcgtcttgatcacaacagagggatcatagttaccaccaagaaactcaagccattgattttgaaagctgttagagaatccatggaagaagagaattttcgtgtttgagacacaactgaaactctacttgtatttgtatttgtattttgtctgaactgataaattgtgtgtgtattgccta

SEQ ID NO: 4816 - DNA, 1257 bp, Brassica napus
cccacgcgtccggtataagctttttgatacatatattatcttgaagctttgtcatgtcgtacgagaaagagctagccgctgcaaagaaagctgttgctctagctgctcgtctcagccaaggagtacaaaagactctgatgcaatcagaagtatggacaaaatccgacaaaactcctgtcactgcagctgattatggatcacaagctgttgttagtattgtactagagagggagctcaaacctgcaaccctgtcattagtagcagaagaggatactagagatctaaggaagaaaggaagtgaggagtttctagaagatataacaaagcttgtgagagatacactagcttctgatgaatcatacgcagactctcctataaccaaagaggatgtgttgaatgccatagactgtggtaaatcacaaggaggaagcagtggttgccactgggttcttgatcctatagatggaaccagaggatttgtaagaggagagcaatacgctgtgggattagccttgcttgtggaaggcaaagtggtggtcggcgttatggcttgtcctaatcttcatttgtcttctgcggttgttgagaaagacgacaagtcttgccaggataatgttggatgtcttttctttgctacaactggttcaggagcttatgtgcaaccgctcaatggcaattctccaccacaggaggtgagagtgagtagcaatgagaatcttgaagaagcaaagttcttagaatcataccatatgccaattcccctccatagttccattgctacgaaacttgggatcacagcgttacctggaaggatcgatagccaagcaaagtatgcagctgtgtcaaaaagagatgcagagatgtacttgcgcttcactcttgttggataccgtgagtggatatgggaccatgcagctggttcaatcatcacaacagaagctggaggcgtcgtttgcgatgctgaagggatacctctggacttctcaaagggaaagcgtcttgatcacaacagagggatcatagttaccaccaagaaactcaagccattgattctgaaagctgttagagaatccatggaagaagagaatattcgtgtctgagactgagacacaactgagaagctactgtatttgtatttgtattttgtctgaactggtaacttgtgtgtgtattgcctagctctttgtattgtctacgtgttagatgtgtaatatatgtgtgcttggaggtcaagattctactttgtttctttgagat

SEQ ID NO: 4817 - DNA, 1256 bp, Brassica napus
  misc_feature (68)..(68): n is a, c, g, or t
  misc_feature (76)..(76): n is a, c, g, or t
  misc_feature (96)..(96): n is a, c, g, or t
  misc_feature (118)..(118): n is a, c, g, or t
  misc_feature (125)..(125): n is a, c, g, or t
  misc_feature (128)..(128): n is a, c, g, or t
  misc_feature (137)..(138): n is a, c, g, or t
  misc_feature (146)..(146): n is a, c, g, or t
  misc_feature (164)..(164): n is a, c, g, or t
  misc_feature (216)..(216): n is a, c, g, or t
  misc_feature (221)..(222): n is a, c, g, or t
  misc_feature (236)..(236): n is a, c, g, or t
  misc_feature (244)..(244): n is a, c, g, or t
  misc_feature (251)..(251): n is a, c, g, or t
  misc_feature (276)..(276): n is a, c, g, or t
  misc_feature (284)..(285): n is a, c, g, or t
  misc_feature (291)..(291): n is a, c, g, or t
  misc_feature (309)..(309): n is a, c, g, or t
  misc_feature (316)..(316): n is a, c, g, or t
  misc_feature (320)..(320): n is a, c, g, or t
  misc_feature (341)..(341): n is a, c, g, or t
  misc_feature (365)..(365): n is a, c, g, or t
  misc_feature (367)..(367): n is a, c, g, or t
  misc_feature (372)..(372): n is a, c, g, or t
  misc_feature (382)..(382): n is a, c, g, or t
  misc_feature (401)..(401): n is a, c, g, or t
  misc_feature (428)..(428): n is a, c, g, or t
  misc_feature (433)..(433): n is a, c, g, or t
  misc_feature (440)..(440): n is a, c, g, or t
  misc_feature (461)..(461): n is a, c, g, or t
  misc_feature (512)..(512): n is a, c, g, or t
  misc_feature (565)..(565): n is a, c, g, or t
  misc_feature (636)..(636): n is a, c, g, or t
  misc_feature (745)..(745): n is a, c, g, or t
  misc_feature (781)..(781): n is a, c, g, or t
  misc_feature (797)..(797): n is a, c, g, or t
  misc_feature (808)..(809): n is a, c, g, or t
  misc_feature (845)..(849): n is a, c, g, or t
  misc_feature (1026)..(1026): n is a, c, g, or t
  misc_feature (1159)..(1159): n is a, c, g, or t
  misc_feature (1180)..(1180): n is a, c, g, or t
  misc_feature (1191)..(1191): n is a, c, g, or t
  misc_feature (1205)..(1206): n is a, c, g, or t
cccacgcgtccggtataagctttttgatacatatattatcttgaagctttgtcatgtcgtacgagaangagctagncgctgcaaagaaagctgttnctctagctgctcgtctcagccnaggagtncanaagactctnntgcaatcngaagtatggacaaaatcngacaaaactcctgtcactgcagctgattatggatcacaagctgttgttagtnttgtnntagagagggagctnaaacctgnaaccctntcattagtagcagaagaggatactngagatctnnggaagnaaggaagtgaggagtttntagaagntatnacaaagcttgtgagagatacnctagcttctgatgaatcatacgcngnctctnctataaccanagaggatgtgttgaatgcnatagactgtggtaaatcacaaggaggnagcantggttgncactgggttcttgatcctatngatggaaccagaggatttgtaagaggagagcaatacgctgtgggattagcnttgcttgtggaaggcaaagtggtggtcggcgttatggcttgtcctaatcttcntttgtcttctgcggttgttgagaaagacgacaagtcttgccaggataatgttggatgtcttttctttgctncaactggttcaggagcttatgtgcaaccgctcaatggcaattctccaccacaggaggtgagagtgagtagcaatgagaatcttgaagaagcaaagttcttagaatcatnccatatgccaattcccctccatagttccattgctangaaacttgggatcacngcgttacctgnnaggatcgatagccaagcaaagtatgcagctgtgtcnnnnngagatgcagagatgtacttgcgcttcactcttgttggataccgtgagtggatatgggaccatgcagctggttcaatcatcacaacagaagctggaggcgtcgtttgcgatgctgaagggatacctctggacttctcaaagggaaagcgtcttgatcacaacagagggatcatagttnccaccaagaaactcaagccattgattctgaaagctgttagagaatccatggaagaagagaatattcgtgtctgagactgagacacaactgagaagctactgtatttgtatttgtattttgtctgaactggtancttgtgtgtgtattgcctagntctttgtatgnctacgtgtagatgnntaatatatgtgtgcttggaggtcaagattctactttgtttctttgagata

SEQ ID NO: 4818 - DNA, 2122 bp, Brassica napus
gttgttgatatttatattcttgaagctttgtaaaatgtcttacgagaaagagctagccgctgcaaagaaagccgtttctctagctgctcgtctcagccaaggagtacagaagactctgtttcagtccgaagtatggacaaaatcagacagaactccggttactgcagctgattttgggtcacaagctcttgttagtattgtattagagagggagcttcaacctgcaaccttttcattagtagcagaagaggaaaccggagaactgcggaagcagggaagtgaggtgtttctagaaggtattacgaagctagtgaaagatactctagcttctgaggaatcatacgcagactctcctcctctatccacagaagatgtgttgaacgctatagactgcggtaaatcagaaggtggttgcagtggttaccactgggttcttgatcctatagatggaaccagaggatttgtgagaggagagcagtacgctgtgggattagcgttgcttgtggaaggcaaagtggtgcttggtgtcatggcttgtccgaatcttcctttagcttctgcggttggtgagacagacatgtcttccaaggagaatgttggctgtcttttctttgctacagctggtttaggggcctacgtgcaaccggttgaaggccattctctgccacagaaggtacgagtgagtagcaatgagaatcttgaagaagcaaagttcttagaatcataccacaaaccaattcccatccatagttccattgccgagaaacttgggatcacagcattaccagtaaggatggatagccaagcaaagtatgcagcagtgtccagaggagacgcagagatatatttgcgtttcactctctgtggacaccgtgagactatatgggaccatgcccctggtttcatcatcacaacagaagctggaggcgtggtttgcgatgctgcagggaagtctctggacttctcgaaaggaaaatatcttgatcacaagacagggatcattgttaccaccaagaaactcaagccatgcgttttgaaggcagtcagagaagccatggaagaggagaaactcatttctgaaacgcacaacccaaactgtactctatctgtatgtgtctgaactggtaactggtgtgtatgctttgttcatatcttggatacgtaataatttgtgcttggaggaaacactacaagaatgaataatgacactaagaaagatttcaatttatttattcgttatcttccaacaaaaggattgtaatatgagtccactagcaatctactttaacgttacatgtaatgtcacaaatccattcacccaacgaggagaaaaacctgggaaattaatatgagcattaagcataactccccaggagatccagagcgttagccgtcctcttcatctgagtcctgcagaagagcacctcgtttacgggttctccggtgagcaggtactcgtttagaaggcttaattgtattagcttctcgggcagattgcttggcgggagagtcttgccggtgatctgttgatggagccataacatctagttggttatgggtagagtccatcttatccttttcatcatttgccgcagctgaagtgctcgtttccccttgcaagtgttgctttctcttgaatgatttgaacaactcgagagacagagttgccattgcctcactagcagatgattcagccatcttcgttagaggaactactatgcgaggcattcctttggccttttgagaaactaatctcgcactctctacaccttttgaaattgaatgatcaccaaggagaagcttcacgttttcggatttcaacgaagcaacagtgtaatcgaggaactcagaccaggagccaccaatgcccacactatccctcatatcgtctagctgcgagacggagaggatcgtctcccaggcgccggatataaagtccgtcacatggacggtgaggtgtaacgaatcggaagcgtagacgtggaagagacaccgccggagtagacccgaacccggatccgaacgctcgggtacgacttctccgaatacgggttcgaatccctcgaaactcgccatgtctaaaaaaagaaggtcgcctcctcctcgcgtactctgcgttgat

SEQ ID NO: 4819 - DNA, 1373 bp, Brassica napus
gttgttgatatttatattcttgaagctttgtaaaatgtcttacgagaaagagctagccgctgcaaagaaagccgtttctctagctgctcgtctcagccaaggagtacagaagactctgtttcagtccgaagtatggacaaaatcagacagaactccggttactgcagctgattttgggtcacaagctcttgttagtattgtattagagagggagcttcaacctgcaaccttttcattagtagcagaagaggaaaccggagaactgcggaagcagggaagtgaggtgtttctagaaggtattacgaagctagtgaaagatactctagcttctgaggaatcatacgcagactctcctcctctatccacagaagatgtgttgaacgctatagactgcggtaaatcagaaggtggttgcagtggttaccactgggttcttgatcctatagatggaaccagaggatttgtgagaggagagcagtacgctgtgggattagcgttgcttgtggaaggcaaagtggtgcttggtgtcatggcttgtccgaatcttcctttagcttctgcggttggtgagacagacatgtcttccaaggagaatgttggctgtcttttctttgctacagctggtttaggggcctacgtgcaaccggttgaaggccattctctgccacagaaggtacgagtgagtagcaatgagaatcttgaagaagcaaagttcttagaatcataccacaaaccaattcccatccatagttccattgccgagaaacttgggatcacagcattaccagtaaggatggatagccaagcaaagtatgcagcagtgtccagaggagacgcagagatatatttgcgtttcactctctgtggacaccgtgagactatatgggaccatgcccctggtttcatcatcacaacagaagctggaggcgtggtttgcgatgctgcagggaagtctctggacttctcgaaaggaaaatatcttgatcacaagacagggatcattgttaccaccaagaaactcaagccatgcgttttgaaggcagtcagagaagccatggaagaggagaaactcatttctgaaacgcacaacccaaactgtactctatctgtatgtgtctgaactggtaactggtgtgtatgctttgttcatatcttggatacgtaataatttgtgcttggaggaaacactacaagaatgaataatgacactaagaaagatttcaatttatttattcgttatcttccaacaaaaggattgtaatatgagtccactagcaatctactttaacgttacatgtaatgtcacaaatccattcacccaaagaggagaaaaacctgggaaattaataagagcattaagcgaaactcccagg

SEQ ID NO: 4820 - DNA, 1235 bp, Arabidopsis lyrata
ttgaagcttttcaatgtcttatgagaaggagctagccgctgcaaagaaagctgtctctctagctgctcgtctcagccaggaagttcagaagactctgtcgcaatcccaagtatggaaaaaatccgatacaagtccagttactgcagctgattacggctcacaagctgttgttagtcttgtattggagagggagctccaacctgataaactgtcattagtagccgaagaggaaactggagatctgcggaagaagggaagtgagttgtttctacaaggtattacaacacttgtgaaagatactctagcttctgaggaattgtacaccggctctcctctatccacagatgatgtgttaaatgctatagactgcggtaaatcagaaggcggtagcagcggttcccactgggttcttgaccctatagatggaaccagaggatttgtaagaggagagcaatatgctgtgggactagcgttgcttgtggaaggcaaagtggtgcttggtgtcatggcttgcccgaatctttctttggcttcagcgatttgcgtgacggataagtcttcccaggaaggtgttggctgtcttttctttgctacaacgggttcaggaacttatgtgcaatcactcaaaggcaattctctaccacagaaggtgcgagtgagtagcaatgagaatcttgacgaagcgaagttcttagaatcataccataaaccaattcccatccatggtaccattgccaagaaactcgggattaaagcattacctgtaaggctcgatagccaagctaagtatgcggctttgtcgcggggagacgcagagatatacttgcgtttcactctcaatggacaccgtgagtgtatttgggaccatgctgcaggttcaatcatcactacagaagctggaggcgtagtgtgcgatgctacagggaaatctctggacttctcgaaaggaaagtatcttgctcacaaaacggggatcatagttaccaccaagaaactcaagccatggattttgaaggcagtcagagaatccattgaagaagagaatctttatttctgaggcacaacagaatctgtacaatacagtatttgtatttgtccgaactagtaactggtgtatattcttagttcatatattgtatacatcagatatgaaagatatttgtgcttagataatgaataatgatactaaggaggattcgattttgcttccgttttcaactttcaaaaacttctaa

SEQ ID NO: 4821 - DNA, 3537 bp, Arabidopsis lyrata
attttttatattttacttttttcctcgacaagtaaaaacaaaacacacaatgacacaaggataaaacctcttttgccgttggctttattttacttctttgcaatatccttatttcgtctccgtcagtagcagtcttcgccgggaaatatatttccggtagcgatgctccgaacagtctcttgtttagcttcgcgcagctcagcccctctattctttcgcttctttcgtcagttccctcgctcttacatgtctctcacatcgtcgacggccgctctccgtgtccccagtcgcaatcttcgccggatttcctctccttcagttgccggaagacgtctctttctccgccgaggtttgaggattccctccgccgcagttcgtagtgtcaatgggcagttctctcgcctctctgttcgcgccgtcgccacacaacccgcaccactttatcccgatgtaggtcaagatgaggctgagaagcttggatttgaaaaagtgtcggaagaattcatctcagagtgtaaatcaaaggcgattctcttcaaacacaagaaaactggttgcgaggtgatgtctgtgtcaaatgaggatgagaacaaggtcttcggcgttgttttcaggactcctccgaaggattccactggcattccgcacatactggaacatagcgttctgtgtgggtcaagaaagtacccgctaaaagagccatttgttgaactactcaagggaagtttgcatacttttctaaatgcattcacatatccagataggacctgctacccagttgcttccaccaatacaaaggatttttacaatcttgtcgatgtatatttggatgctgtcttcttccccaagtgtgtggatgacgtgcacacctttcagcaagagggctggcactatgagcttaatgatccctctgaagacatatcttacaaaggtgttgtttttaatgagatgaaaggtgtctattcacagcctgataatattttagggcgaattgctcaacaggcaaaaaatacatatggtgttgacagtggaggtgatccaaaagatatccctaagctgacatttgaggaattcaaggagttccaccgtcagtattatcacccaagcaatgccaggatctggttctatggagatgatgatcccgttcaccgccttcgtgtcttgagtgaatacttggacatgtttgaagcaagtccatctcccgatagttcaaagattaaacctcaaaagttattctctaagcctgtcagactggttgagaaatatcctgctggtcgagatggtgaccttaaaaagaagcacatgttgtgcgttaactggctattgtctgagaagcccttggacttgcaaactcagcttgcacttggcttcttggatcatcttatgctggggactcctgcttcaccactaagaaaaatcttattggaaagcggtttaggagaagctcttgtcagtagtgggttgtcagacgaactattgcaaccccagttcagtattggtttgaaaggtgtgtccgaagataatgttcaaaaggttgaagagttgatcatggatactctgaaaaagttggcagaagaagggtttgacaatgatgctgtggaggcatccatgaatacaattgagttttctctgagggaaaacaacacaggatctttccctcgtggtttatcacttatgctccaatctattgcaaaatggatatacgatatggatccttttgagccattaaagtatacggaaccattgaaggccctgaaaaccagaatagctgaggagggatccaaggccgtcttttccccactgatagagaagtttatcttgaacaactcgcatcgtgttaccatagagatgcagcctgatcccgaaaaagctactcaagaggaagtggaagagaaaaatatcctggaaaaagttaaagcagctatgacagaagaagatcttgcagagctagcacgtgccacagaggagctaaaattgaaacaagaaactcctgaccctcctgaagcattgagatgtgttccaagtttgaacttgggtgacattccaaaagaacctacttatgttcccaccgaggttggagatattaatggtgtgaaggttttgcggcatgaccttttcaccaatgatattatctacgctgaagtagtctttgatattggttccctgaaacatgagcttcttccactagtaccacttttctgtcaatcattactggagatgggcacaaaagatttgacttttgttcaacttaatcagttgattggaaggaaaacgggagggatatcagtttatccccttacatcatcagttaggggtaaggatgaaccatgcagcaaaattatcgtacgcggaaaatccatggctgggcgtgctgacgacctttttaacctgatgaattgcttgttgcaagaggttcaatttacagatcagcagaggtttaaacagtttgtctctcaaagcagagcacggatggagaaccgattgaggggaagtggtcatggaattgctgcggcgaggatggatgcaatgttgaacattgctggatggatgtctgaacagatgggtggtctcagctatcttgaatttttacatactcttgaaaagaaagtggatgaagactgggaaggaatttcatcctcacttgaggagatcagaagatctctccttgccaggaatggttgcatagttaacatgactgctgatgggaagtctctcaccaacgtcgaaaaatctgttgcgaaatttctagatttactccctgagaagccctccggtgggctggtcacttgggatggtcgacttcctctcagaaatgaagctattgtgataccaacccaggtaaactatgttggaaaagcaggtaacatatacagcaccggatatgagcttgatggcagtgcatatgttatatcaaagcatataagcaatacatggttatgggatcgtgttcgtgtaagcggtggtgcatatggaggtttctgtgacttcgattcgcattcaggagtattttcttacttatcttaccgggatccaaacttgttgaagacacttgacatatatgatggaactggagatttcttacgtggccttgatgtggatcaagaaacactcactaaagctattataggcaccatcggtgatgttgattcataccaattacctgatgccaaaggttatagcagtttgttgaggcatttactcggagtaactgacgaagaacggcaaagaaagcgtgaagagatattaacaacaagtttgaaggacttcaaggatttcgcagaagcaatagatgtggttagagataaaggtgttgcggtggctgtggcatccgcagaagacattgatgcagcaaacaatgaacgctccaactttttcgaggtgaagaaagctctctaaagggattggacaactttcacaataatatttacgattgagaatctcattagatttctcttggtttcttttctactagagtcatcaatgtcttctcaaagctattattaaatgtccaaatattaagaattttcacagtaaatg

SEQ ID NO: 4822 - DNA, 3559 bp, Arabidopsis thaliana
attttattttattttacttttttcctctacaagcaaaaacacacaactacacaaggataaaacctcttgccgttgggtttatttagcttctttgcaatatccttaatttcgtctccgtcagtagcagtctccgccgggaatattttttttccggtagctatgctccgaaccgtctcttgtttagcttcgcgcagctcgtcctctctattctttcgcttctttcgtcagttccctcgctcttacatgtctctcacatcgtcgacggcagctctccgtgtccccagtcgcaatcttcgccgaatttcctctccctcagtcgccggtagacgtcttttgctccgacgaggtttgaggattccctccgccgcagttcgcagtgtcaatgggcagttctctcgcctctctgttcgcgccgtcgccacacaacccgctccactttatcctgatgtaggtcaagatgaggctgagaagcttggatttgaaaaagtgtcggaagaattcatctcagagtgtaaatcaaaggcgatactcttcaaacacaagaaaactggttgcgaggtgatgtctgtgtcaaatgaggatgagaacaaggtcttcggtgttgttttcagaactcctccgaaggattccactggcattccgcacatactggaacatagcgttctatgtgggtcaagaaagtacccggtaaaagagccatttgttgaactactcaagggaagtttgcatacttttctaaatgcattcacatatcctgataggacctgctacccagttgcttccaccaatacaaaggatttttacaatcttgtcgatgtatatttggatgctgtcttcttccccaagtgtgtggatgacgctcacacctttcagcaagagggctggcactatgaacttaatgatccctcggaagacatatcttacaaaggtgttgtttttaatgagatgaaaggggtctattcacagcctgataatattttagggcgaattgctcaacaggccttatccccagaaaatacatatggtgttgacagtggaggtgatccaaaagatattcctaatctgacatttgaggaattcaaggagttccaccgtcaatattatcacccaagcaacgccaggatctggttctatggagatgatgatcccgttcaccgcctccgtgtcttgagtgaatacttggatatgtttgaagcaagtccatctcccaatagttcaaagattaaatttcaaaagctattctctgagcctgtcagactggttgagaaatatcctgctggtcgagatggtgaccttaaaaagaagcatatgttgtgcgttaactggctattgtctgagaagcccttggacttgcaaactcaacttgcacttggcttcttggatcatcttatgctggggactcctgcttcaccactaagaaagatcttattggaaagcggtttaggagaagctcttgtcagtagtgggttgtcagacgaactcttgcagccccagttcggtattggtttgaaaggtgtgtccgaagagaatgttcaaaaggttgaagagttgatcatggatactctgaaaaagttggcagaagaagggtttgacaatgatgctgtggaggcatccatgaatacaattgagttttctttgagggaaaacaacacaggatctttccctcgtggtttatcacttatgctccaatctatttcaaaatggatatacgatatggatccttttgagccattaaagtatacggaaccattgaaggccctgaaaaccagaatagctgaggagggatccaaggctgtcttttccccactgatagagaagcttatcttgaacaactcgcatcgtgttaccatagagatgcagcctgatcctgaaaaagctactcaagaggaagtggaagagaaaaatatcctggaaaaagttaaagcagctatgacagaagaagatcttgcagagctagcacgtgctacagaggagctgaaattgaaacaagaaactcctgaccctcctgaagcattgagatgtgtcccaagtttgaacttgggtgacattccaaaagaacctacttatgttcccaccgaggttggagatattaatggtgtgaaggttttgcggcatgaccttttcaccaatgatattatctatactgaagtagtctttgatattggttcgctgaaacatgagcttcttccactagtaccacttttctgtcaatcattactggagatgggcacaaaagatttgacttttgttcaacttaatcagttgattggaaggaaaacgggagggatatcagtttatccccttacatcatcagtgaggggtaaggatgaaccatgcagcaaaattatcgtacgcggaaaatccatggctgggcgtgctgacgacctttttaacctgatgaactgcttgttgcaagaggttcaatttacagatcagcagaggtttaaacagtttgtctctcaaagcagagcacggatggagaaccgattgaggggaagtggtcatggaattgctgcggcgaggatggatgcaatgttgaacattgctggatggatgtctgaacagatgggtggtctcagctatcttgaatttttacatactcttgaaaagaaagtggatgaagactgggaaggaatttcatcctcgcttgaggagatcagaagatctctccttgctagaaacggttgcatagttaatatgactgctgatgggaagtctctcacaaatgtcgaaaaatctgttgcaaaatttctagatttactccctgagaacccgtctggtgggcttgtcacttgggatggtcgacttcctctgagaaatgaagccattgtaataccaacccaggtaaactatgttggaaaagcgggtaacatatacagcaccgggtatgagcttgatggcagtgcgtatgttatatcaaagcatattagcaatacatggttatgggatcgtgttcgtgtaagtggtggtgcatatggaggtttctgtgatttcgattcgcattcaggagtattttcttacttatcgtaccgggatccaaacttgttgaagacacttgatatatatgatggaactggagatttcttacgtggccttgatgtggatcaagaaacactcactaaagctattattggcaccatcggtgatgttgattcataccaattacctgatgccaaaggttatagcagtttgttgaggcatttactcggagtaactgacgaagaacgacaaagaaagcgtgaagagatactaacaacaagtttgaaggacttcaaggatttcgcacaagcaatagatgtggttagagataaaggtgttgcggtggctgtggcatccgcggaagacattgatgcagcgaacaatgaacgctccaactttttcgaggtgaagaaagctctctaaacagattggacaactttcagtaatactatttacgattgagaatctcattagatttctcttggtttcttttctaccggagtcaatgtcttgtcaaagctatattattgaatgtccaaacgttacgaattttcacagtaaatgaagcattttcacaacc

SEQ ID NO: 4823 - DNA, 3583 bp, Arabidopsis thaliana
gcatccttaagcacagtctttgccggagaaaatattccggtagccatgctccggtcattaacttgttcctcgaccattacttcgacctctctcttcttccgctctttccgccagctccctcgctcttacttgtctccctcatcgtcaacgaccgtcgtcggtgcctccggccgcaacattcgccggctttctactctagaagctgctgggagacggctatttctacgacgaggcttgaaactactctccgccgcgagtcgtggtctcaatggacagttctctcgcttatctattcgcgccgtcgctacacaatccgcaccttcttcttatcccggtcaagatgaggctgagaagcttggatttgagaaagtctctgaagagtttatctcagagtgtaaatctaaggctgttctcttcaaacacaagaaaactggttgcgaggtgatgtctgtttctaacgatgatgagaacaaggtgtttggcattgttttcaggactcctccgaaggattccactggcattcctcacatactggaacatagcgtattatgtgggtcaagaaagtacccgatgaaagaaccatttgtcgaattattaaagggaagtttgcatactttcctaaacgcattcacatatcctgataggacttgttacccagttgcttccacaaataaaaaggatttctacaatcttgtcgatgtatacttggacgctgtattcttccccaagtgtgtggatgatgttcacacttttcagcaggagggttggcattatgagcttaacgatccttcagaggacatatcttacaaaggcgttgtttttaatgagatgaaaggtgtctattcacagcctgataatatactagggcgggttactcaacaggcattatgtccagaaaatacatacggtgttgacagtggaggtgatccaaaagatatccccaagcttacgttcgagaaatttaaggagttccaccgtcagtattatcaccctagcaatgccaggatatggttctatggagatgacgatccagttcaccgccttcgcgtcttgagtgaatacttggacatgtttgatgcaagtccagctcgagatagttcaaaggttgaaccacaaaagcttttctctagacctcgtaggattgttgaaaaataccctgctggtgaagatggtgaccttaagaagaagcatatggtgtgccttaactggcttctctctgacaagccactggacttacaaactcaactcgcacttgggtttttggatcatctaatgcttgggactcctgcctccccattgagaaaaatcttattggaaagcggtttaggagaagctcttgttaatagtgggatggaagatgaacttctccagccccaattcagtataggtttgaaaggtgtttccgatgataatgtccaaaaagttgaagagttggtcatgaatactctgagaaagttggcagatgaggggtttgacactgatgctgttgaagcatccatgaataccattgagttttctctgagagaaaacaatacagggtcgtcccctcgtggtttatcacttatgcttcaatcaattgcgaaatggatatacgacatggatccttttgagccattaaagtatgaggaaccattgaagtccctgaaagctagaatagctgagaaaggatccaagtctgtcttttctccgctgatagaggagtatattttgaacaaccctcattgtgttactatagagatgcagcctgatccagaaaaagcttctctagaggaagcggaggagaaaagtattctagaaaaagttaaagcaagtatgacagaagaggatcttacagaactagcgcgtgccacagaggagttgagattgaagcaagagactcctgaccctcctgacgcactgaaatgcgttccaagtttaaatttgagtgacattccaaaagaacctatatatgttcccactgaggttggagatattaatggcgtgaaggtgttgcggaatgatctctttacaaataatatactctacactgaagtagtctttgatatgggctcagtaaagcatgagcttcttcaactgatacccctcttctgtcaatcattactagagatgggcacgcaagatttgacttttgtacaacttaatcagttaattggaagaaagacaggagggatatcagtttatccccttacatcctctgtgtatggtagggatgatccatgtagcaaaatcattgtgcgtggaaaatccatggttggacgcgctgaagaccttttcaatttgatgaactgtgtgctgcaagaggttcgatttaccgatcaacagcggtttaaacaattcgtttctcagagtagagcacgaatggagaaccgattgaggggaagtggtcaaggaattgctgctgcgaggatggatgcaatgttgaacgttgctggatggatgtctgaacagatgggtggtctcagttaccttgaatttctacacactcttgaacagaaggtggatcaagactgggaaggaatttcatcctcacttgaggaaatcagaagatctttcctttccaggaatggttgcatagttaatatgactgctgatgggaagtccctcacaaacacggaaaaatatgttggaaaatttcttgatttactccctgaaaatccgtctggtgaactcgtcacttgggatgctcgacttcctttgagaaatgaagctatagtaataccaacccaggtgaactatgtgggaaaagcgggaaatatatacagcagtggctacaaacttgatgggagttcatatgttatatcaaagcatattagtaacacatggttatgggatcgtgttcgtgtaagtggtggtgcatatggaggttcctgtgattttgattcacattcgggagtattttcgttcttatcttaccgtgatcccaacctattaaagactctagacatatatgatggaactggggatttcttacgtggcctcgatgtcgatgaagacacccttaccaaagcaattattgggacaattggcgatgtcgattcataccaactccctgatgccaaaggttataccagtttgttgaggcatttacttaatgtaaccgacgaagagaggcaaataaggcgtgaagagatattatctacaagtttgaaggacttcaaggaattcgcagaggcaatagactctgttagtgataaaggcgttgcagtggccgtggcatcacaagaagacattgatgcagcaaacagagaacgctcaaattttttcgaggtgaagaaagcagctctctgagtctgagaccctcttagaaagtagcttgtcacaatgaggaatgactcttcttaggttcacggtcgtaggtcttaaacatttccaagtgaaattgaaacgcttattcttttaggacattggcatcaagatctctatgttacttttataagtgaattagtctttaaagttactttttattaacattgattcataaagataacttttgtaaattagcccataaacaaagatacttgtattgatgaatcttcttcgtctcatccttttaccattatccttgaaaattctgattacatca

SEQ ID NO: 4824 - DNA, 1680 bp, Raphanus sativus
  misc_feature (25)..(25): n is a, c, g, or t
  misc_feature (62)..(62): n is a, c, g, or t
  misc_feature (142)..(142): n is a, c, g, or t
  misc_feature (157)..(157): n is a, c, g, or t
  misc_feature (179)..(179): n is a, c, g, or t
  misc_feature (202)..(202): n is a, c, g, or t
  misc_feature (220)..(220): n is a, c, g, or t
  misc_feature (520)..(520): n is a, c, g, or t
  misc_feature (760)..(760): n is a, c, g, or t
  misc_feature (859)..(860): n is a, c, g, or t
  misc_feature (1028)..(1028): n is a, c, g, or t
  misc_feature (1315)..(1315): n is a, c, g, or t
ggattcatcatctctctgcgcctcnctctctctctcaaactctcagctcacacagacgacantcatcatggggaagaagaagttcatcgacaagaaaaaggcggcgactttcgagctctgccctcgcgacacctcagacccnttatacagcgacgcncccggaggcgataagatcttcntacgagtcgatcagaaccctgtnaacatcaacggtttcacngaagacaactcacagttcgatgacgcccctgaagaaggaggagaagaagatttggcttacggctactccagcttcgcgggttcgagcagcagcaacaacaaccctttgcctgctcacgtgaggaaggagattctcgagctgggttaccctgacgatgggtataactacttggaccatttgagagagatcaagaacactggcggcggttctaacttctactctaaccctaagttcgaaggcgagcatcttcctcgtgacgacgtcaaggcttatgatgcgtctcgtgtgaaggtctctggngtggtggtggaaggtggtggagatgatgataagttgatgtatagcgtggcgtccaagactgttaatgtgaaggtgaagaaggctattgatcctgaagtggcggctttgcttgaggatagcgatgggtctgagtttggttctgatgttgaggatttggaggaggattttgtcgttcaagctcaagagggagagggtggttctgaggttggtggagtttgctgatgagagacctgttgtggntgagagcaagccgagagttatgcgtcagattgatgagatgtttgatcagcttgagcttaatgagtatggaagtgagagtgaggacaatgatggttaccnngaagaggaagaagaagaagagttcaatgctcagagcgttggtaataatcttatttacgagaagccgaaaggttacgagcttgatgatgagaagtatatgaaccctgcggatctgttgaagaacagtgacaatgtgaaagacaaagaggagcttgagaacatcatccgnaggtctgtgcagtacggtgaggatttggttaacggcaatgaagatgagtttgtggaggtggttgaagagagcagcgacgagagcgagaagtgggattgcgagaccatagtcacgacgtactcgaatctcgataaccaccctggtagaatctgtgatccggagagagctaggaagaagctgagcgaagcgttagctaaggcaaagagtgtgaatgggagtggtagtagaatcattaccctccaaggcaaagagaagcttccggttgagtttttacccggtaggagagntgagcaaacaaccagtgtcaaaccgaaagctgaaccggtgaagaggaaggctcacggggaagagacgaaagaggagaagaaagagaggaaagctgctgtgaaaacagagaagagggaagcgaggaagatgaagaaagagacgaaggagctttataggtttgaaacgcagcgtgctcagaaagctgttgctgtttctggtccatcttctattcctctttaagggtaatactaaacgtatctcagagccccagtatttttttttttaatatcgtttcatgtaatattttgtgttttgttcaagattttgaatctctcttatttttgtaaggacgtctttactttttttactagtcaagtttcgagga

SEQ ID NO: 4825 - DNA, 1367 bp, Brassica rapa
catctttgaattgaataccttttattcaaaaaaagtctctgggcaaatcattgcaactgaattagcagaggaggaggggaggggaagggagattcatggctgaacatcatcatcgcatcagagtctacttagcctctgctatcttacttttagcggttattaatacgggaattgcagcagagaatctttcccagcagaagctaacttcacgaattcttcagaatgagattgtgaaagaagtcaatgagaatccaaacgctggatggatagctgctttcaatgatcgctttgctaactccaccgttgcagagtttaagcgcctcctcggtgttaaaccaacacctaagaacgaattcttaggcgtacctgttgtaagccatgacatctctctcaagcttcctaaagaatttgacgctagaactgcttggtctcagtgctccagtattggaaggatcctagatcagggtcactgcggttcttgctgggcatttggggcggtagagtcactgtctgacaggttctgcatcaaatataacatgaatatatctttatcagtcaatgatctcttagcatgttgtggattcctttgcggtcaaggctgtaatggtggctaccctatttccgcgtggcgatactttaagcaccacggtgtagtcaccgaagagtgtgatccatactttgacaatactggatgctcacacccgggatgtgaacccgcttaccctacaccaaaatgtgtgaggaaatgtgttagtggaaaccagctttggcgtgaatcaaaacactatggtgttagcgcctacaaagtcagacatggccctcaagacattatggctgaagtttacaaaaacggacctgttgaggttgcctttaccgtttatgaggactttgcgcattacaaatctggagtgtacaagcacataacaggtgcaaacattggaggtcatgctgtcaagcttattggctggggaacttctgatgatggcgaagattattggttgcttgcaaatcaatggaaccgaagctggggtgatgatggttacttcaagatcaagagaggaacgaacgaatgtggaatcgaacacggtgttgtagccggtttgccttcagacaggaacgtctttaatggtattaatacatcagatgatgttctagtttcctcattttaaaactaaaaatcagaaaacaaaagacgtgtttctgtctcgacactctctgtaatatatgtaatttgcttcctgtttccaatgaaaagaatcaaacgacttcaataaacccaaacaaaagtatattaactacaaaatatacccttttagcttttgttcactacagagatctgatcaaagaaacaacgctatatgacaaac

SEQ ID NO: 4826 - DNA, 1283 bp, Brassica napus
aaaaagtctctgggcaaatcattgcaactgagttagcagaggaggaggggaggggagattcatggctgaacatcatcatcgcatcagagtctacttagcctctgctatcttacttttagcggttattaatacgggaattgcagcagaaaatctttccgagcagaagctaacttcacgaattcttcagaatgagattgtgaaggaagtcaatgagaatccaaacgctggatggacagctgctttcaatgatcgctttgctaactccaccgttgcagagtttaagcgcctcctcggtgttaaaccaacacctaagaacgaattcttaggcgtacctgttgtaagccatgacatctctctcaagcttcctaaagaatttgacgctagaactgcttggtctcagtgctccagcattggaaggatcctagatcagggtcactgcggttcttgctgggcatttggggctgtagagtcactgtctgacaggttctgcatcaaatataacatgaatatatctttatcagtcaatgatctcttagcatgttgtggattcctttgcggtcaaggctgtaatggtggctaccctatttccgcgtggcgatactttaagcaccacggtgtagtcaccgaagagtgtgatccatactttgacaatactggatgctctcacccgggatgtgaacccgcttaccctacaccaaaatgtgtgaggaaatgtgttagtggaaaccagctttggcgtgaatcaaaacactatggtgttagcgcctacaaagtcagacatgaccctcaagacattatggctgaagtttacaaaaacggacctgttgaggttgcctttaccgtttatgaggactttgcgcattacaaatctggagtgtacaagcacataacaggtgcaaacattggaggtcatgctgtcaagcttattggctggggaacttctgatgatggcgaagattattggttgcttgcaaatcaatggaaccgaagctggggtgatgatggttacttcaagatcaagagaggaacgaacgaatgtggaatcgaacacggtgttgtagccggtttgccttcagacaggaacgtctttaatggtattaatacatcagatgatgttctagtttcctcattttaaaactaaaaatcagaaaacaaaagacgtgtcgctgtctcgacactctctgtaatatatgtaatttgcttcctgtttccaatgaaaagaatcaaaagacttcaataaacccaaacaaaagtatattaactacaaaatatacccttttagc

SEQ ID NO: 4827 - DNA, 1386 bp, Brassica napus
gaagccccttctcttcttcttttttttttattttagaaaagagatcatcatcatctttgaattgaataccttttatccaaaaagtctctgggcaaatcattgcaactgagttagcagaggaggaggggaggggagattcatggctgaacatcatcatcgcatcagagtctacttagcctctgctatcttacttttagcggttattaatacgggaattgcagcagaaaatctttccgagcagaagctaacttcacgaattcttcagaatgagattgtgaaggaagtcaatgagaatccaaacgctggatggacagctgctttcaatgatcgctttgctaactccaccgttgcagagtttaagcgcctcctcggtgttaaaccaacacctaagaacgaattcttaggcgtacctgttgtaagccatgacatctctctcaagcttcctaaagaatttgacgctagaactgcttggtctcagtgctccagcattggaaggatcctagatcagggtcactgcggttcttgctgggcatttggggctgtagagtcactgtctgacaggttctgcatcaaatataacatgaatatatctttatcagtcaatgatctcttagcatgttgtggattcctttgcggtcaaggctgtaatggtggctaccctatttccgcgtggcgatactttaagcaccacggtgtagtcaccgaagagtgtgatccatactttgacaatactggatgctctcacccgggatgtgaacccgcttaccctacaccaaaatgtgtgaggaaatgtgttagtggaaaccagctttggcgtgaatcaaaacactatggtgttagcgcctacaaagtcagacatgaccctcaagacattatggctgaagtttacaaaaacggacctgttgaggttgcctttaccgtttatgaggactttgcgcattacaaatctggagtgtacaagcacataacaggtgcaaacattggaggtcatgctgtcaagcttattggctggggaacttctgatgatggcgaagattattggttgcttgcaaatcaatggaaccgaagctggggtgatgatggttacttcaagatcaagagaggaacgaacgaatgtggaatcgaacacggtgttgtagccggtttgccttcagacaggaacgtctttaatggtattaatacatcagatgatgttctagtttcctcattttaaaactaaaaatcagaaaacaaaagacgtgtcgctgtctcgacactctctgtaatatatgtaatttgcttcctgtttccaatgaaaagaatcaaaagacttcaataaacccaaacaaaagtatattaactacaaaatatacccttttagcttttgttttaaaaaaaaaagaggag

SEQ ID NO: 4828 - DNA, 1448 bp, Raphanus sativus
  misc_feature (47)..(47): n is a, c, g, or t
  misc_feature (55)..(55): n is a, c, g, or t
  misc_feature (67)..(68): n is a, c, g, or t
ggaattttagagttttagaaaagaaagaaaccatctttgatttgaanagaatacnaccacacacttnnttttatccaaaaagtcggcaaatcattgttttgtttgattgattctctgggaactgattgagcagaggaggggagattaatgggtgatcatcatcatcatcatcgcatcatcagagtctactacttagcctttgctatcttacttttacttttaggggagggaaatgcatttggagcagacaatctttctaatcagaagctgacctcaccaattctccaggatgagattgtgaagcaagtcaatgagaatccaaaggctggatggaaagctgcttttaatgatcgctttgctaactccaccgttgcagagtttaagcgcctcctcggtgttaaaccaacacctaagaacgcattcttaggtgtacctgttgtaagccatgacatctccatctctctcaagcttcctaaacaatttgacgctagaaccgcttggtctcagtgctccagtattggaaggatcctagatcagggtcactgtggttcttgctgggcatttggggctgtagaatcattgtctgacaggttctgcatcaaatataacatgaatatttctttatcagtcaatgatctcttagcatgttgtggattcctttgcggtcaaggctgtaatggtggctaccctatttccgcctggcgatactttaagcaccacggtgtagtcaccgaagagtgtgatccatactttgacaatactggatgctcacacccgggatgcgaacccgcataccctacaccaaaatgtgtgaggaaatgtgttagtggaaaccagctttggcgtgaatcaaaacactatggtgttagcgcctacaaagtcaggcatgaccctcaagacattatggctgaagtttacacaaacggacctgttgaggttgcctttaccgtttacgaggactttgcgcattacaaatctggagtgtacaagcacataacaggtgctaacattggaggtcatgctgtcaagcttattggctggggaacttctgatgatggcgaagactattggttgcttgcaaatcaatggaaccgaagctggggtgatgatggttacttcaagatcaagagaggaacgaacgaatgtggaatcgaacacggtgttgtagccggtttgccttcagacaggaacgtctttagaggtgtaaatacttccgatgatgttctagtttcctcattttaaaactacaaaatgagaaaacaaaagacgtgtctcgactctctctctctctctctctgtaatataatgtaatttgcttcttgtttccagtgaaaagaatcaaaaagattctaataaacccaaacaaaagtatattaactacaattaataccatttagcttttgtccatgctcagttttacatattaatttatactgttttcattctgc

SEQ ID NO: 4829 - DNA, 1366 bp, Arabidopsis lyrata
taccttgtccaaactctctggcaaatcatttgtttggtttttggagttcgtttaagggattgagaaaatatcaacagaagagaaagattcatggctgataaatgtatcaaacttcacttagcctctgttttcttctttttagggcttctaatttcatccttcaacttgcagggtattgcagcagaaaatctttccaagcagaaactgacctcatggattcttcagaatgagatcgtcaaggaagtcaatgagaatccaaacgctggatggaaagctgctttcaatgatcggtttgcaaacgccactgttgcagagtttaagcgcctccttggtgttaaaccaacaccaaagacggaatttttgggtgtacctattgtgagtcatgatatatctttgaagcttcctaaagaatttgatgctagaaccgcttggtcacagtgcaccagtgttggaaggatcttaggtctggtcattgtggttcttgctgggcctttggtgctgttgaatcactgtctgacagattctgcatcaaatataacatgaatatttctttatctgtcaatgatctcttagcatgttgtggattcctttgcggacaaggttgtaacggtggatacccaattgctgcgtggcggtactttaagcaccacggtgtagtaactgaagagtgtgatccatactttgacaatactggctgctctcacccgggatgtgaacccgcttaccctacaccaaaatgtgcgaggaaatgtgttagcggaaaccagctttggcgtgaatcaaaacattatggtgttagcgcgtacaaggtcagatctcaccctgatgacattatggcagaagtttacaaaaatggacctgttgaggttgcctttactgtttacgaggactttgcacattacaagtcaggagtgtacaagcacataacaggtactaacattggaggtcatgctgttaaacttattggctggggaacttctgatgacggtgaagattattggttgcttgcaaatcaatggaaccgaagctggggagatgatggttacttcaagatcaggagaggaacaaacgaatgtggcattgaacatggtgttgtagctggtttaccttcagacaggaacgtatttaaaggtattactacttcagatgatcttcttgtttcctcattttaaacaggaagatgtgtctctacttcttctgtaatacataatttgccagtgtgttgttgttaccaatgaaataattaaacgactttcgacccaaaaagaagtctattgtacatagcatttagctttttttttatatccaatataatgtgttgttgtttccattgaaagaatcaaaagacattcaactattctatata

SEQ ID NO: 4830 - DNA, 1407 bp, Arabidopsis thaliana
aagcctctctctgtctcttcctagaaaagaaaactttgtaccttttccaaagtctaagcaaatcattgtttttgattactggaactcgttgagggattgagaaaaaaataatcagaagagaaagatccatggctgataattgtatcagacttcttcactcagcctctgttttcttctgtttagggcttctaatttcatccttcaacttgttgcagggtattgcagctgaaaatctttccaagcagaaactgacctcatggattcttcagaatgagattgtaaaggaagtcaatgagaatccaaacgctggatggaaagcttctttcaatgatcggtttgcaaacgccactgttgcagagtttaagcgccttcttggtgttaaaccaacaccaaagacggaatttttgggtgtgcctattgtaagccatgatatatctttgaagcttccaaaagaatttgatgctagaaccgcttggtcacagtgcaccagtattggaaggatcttagatcagggtcactgtggttcttgctgggcctttggtgctgttgaatcactgtctgacagattctgcatcaaatataacatgaatgtttctttatctgtcaatgatcttttagcatgttgtggattcctttgcggtcaaggttgtaatggtggatacccaattgctgcgtggcggtactttaagcaccacggtgtagtcactgaagagtgtgatccatacttcgacaatactggttgctcgcacccgggatgtgaacccgcttaccctacaccaaaatgtgcaaggaaatgtgttagcggaaaccagctttggcgtgaatcaaaacattatggtgttagtgcgtacaaggtcagatctcaccctgatgacattatggcagaagtttacaaaaatggacctgttgaggttgccttcactgtttacgaggactttgcgcattacaaatctggagtgtacaagcacataacaggtactaacattggaggtcatgctgttaaacttattggctggggaacttctgatgacggtgaagattattggttgcttgcaaatcaatggaaccgaagctggggtgatgatgggtacttcaagatcaggagaggaacaaacgaatgtggcattgaacatggtgttgtagctggtttaccttcagacaggaacgtagttaaaggtattactacttcagatgatcttcttgtttcctcattttaaacaggaatatgtgtctctactctgtaatacataatttcccactgtgttgttgttaccaatgaaataaaacgactttcaacccaaaaagaagtctattgtatataccatttagctttttgttcatattcaatataatgtgttgttgtttccaatgaaagaatcaaaagacattcaactattctacatatca

SEQ ID NO: 4831 - DNA, 1274 bp, Thellungiella halophila
  misc_feature (761)..(762): n is a, c, g, or t
  misc_feature (856)..(856): n is a, c, g, or t
  misc_feature (896)..(896): n is a, c, g, or t
ggattacgttttctaaagtctgggagaaatcattctggagttcattgagagagatcgagataattgtgtcaaagagaagattcatggctgtttcttgtatcagactctacttagtctctgctatcttgctcttagggattattagttcatctttcaacttgcagggaattgcagcagaaaatcttaccaagcagaaactgacatcacggattcttcaggacgagattgtaaaggaagtcaacgagaatccaaacgctggatggaaagctgctttcaatgatcggtttgcaaacgccaccgttgcagagtttaagcgcctcctcggtgtcaaaccaacaccaaagaaggaatacttaggtgtacctattgtaagccatgacagatctctgaagcttccaaaagaatttgatgctagaaccgcttggtcacagtgcaccagtattgcaaggatcttagatcagggtcactgtggttcttgctgggcatttggtgctgttgaatcattgtctgacagattctgcatcaaatataacatgaatatatctttatctgtcaatgatctcttagcatgctgtggattcttgtgcggacaaggttgtaatggtggatacccaatttctgcttggagatactttaagcaccacggtgttgtaaccgaagagtgtgatccatactttgacaataccggctgctctcacccgggatgtgaacccgcatacccttttccaagatgtgtgaggaaatgtgttagtggaaaccanntttggcgtgaatcaaaacactatggtgttagtgcctacaaaatcagatctaaccctcaagacatcatggcagaagtttacaagaacggacctgncgaggttgatttcacctttacgaggactttgcgcattacnaatctggagtgtacaagcacataactggaagtaacattggaggccatgctgttaagcttattggatggggaacttctgatgacggcgaagattattggttgcttgcaaatcagtggaaccgaagctggggtgatgatggttatttcaagatcaggagaggaacaaacgaatgtggtatcgaacacggtgctgtagctggtttaccctcagacaggaacgtatttaaaggtattactacatcagatgatcttctagtttcctcattttaaattatattcagacaacgaaagaggtctctatacactctgtaatatactataagctgccacgatgttgttgttccagtgaaagaatcaaaacagttgaaaacccaaaaaa

SEQ ID NO: 4832 - DNA, 1350 bp, Raphanus sativus
gggaaaaacaaatagatgattcgtctctctctatctaaaaatctaagccttttgtgtctttctctctctgattagaaaaaaagtcttctatcctttccaaattcttggcaaatcattgtttgattctggaattgtatcgaagagagagagaagagggagattcatggctaataatcatagcatgctctacttagcatctgttatcttgcttgtagggattatcagttcatcattcaacatgcagggcattgcagcagaaaatctttccaagcagaaactcacctcacgaattcttcaggaagagattgtaaaggaagtcaatgagaatccaaacgctggatggaaagctgctctcaatgatcgctttgctaatgccaccgttgcagagtttaagcgcctcctcggtgttaagccaacaccaaagaatgaatacttaggtggtgtacctgttgtcacacatgacacatctctcaagcttccaagagaatttgatgctagaaccgcctggtcacagtgcaccagcattggaaggatcctagatcagggccactgtggttcttgctgggcatttggtgctgtggaatcattgtctgacagattctgcatcaaatataacatgaatatttctttatcagtcaatgatctattagcatgttgtggattcctttgcggtcaaggctgtaacggtggccaccctatttccgcatggctgtactttaagcaccacggtgtagtcactgaagagtgtgatccatactttgacaagaccggatgctcacacccgggatgtgaaccagcatggtctacaccaaaatgtgtgaagaaatgtgttggtggaaaccagctttgggatgaatcaaaacactatggagttagcgcttacagagtcagtcatgaccctcaagacattatggcagaagtttacaaaaacggacctgttgaggttgcctttaccgtttacgaggactttgcacattacaaatctggagtgtacaaacacataacaggtagtaacattggaggtcatgctgttaagcttattggctggggaacttctgatgatggcgaagattattggttgcttgcaaatcaatggaaccgaagctggggtgatgatggttacttcaagattaagagaggaacaaacgaatgtggcatcgaacacggtgctgtagccggtttaccttcagacaagaacatagttagaggtattaatacttcggatgatgttctaatttcttcgttttaaagctaaaatcaagatgcgctctctcaactctctgtaacatatgtaacaagccactgtattattgtttccaatgaaagaatcaaaagactttataaacccaa

SEQ ID NO: 4833 - DNA, 2442 bp, Arabidopsis lyrata
gttcatcggagaaaattagggtttatatcggcgaacggaaaaaatgggtacttcggtgcaagttactcctctctgcggagtttacaatgagaatcctctctcctacttagtctccattgatggtttcaacttcctcatcgactgtggttggaacgatctctttgacacatcgctcctcgaacctctctccagggttgcttctagtatagatgcagttttgctttctcatccagatacgcttcatcttggtgctcttccttatgctatgaagcagcttggactctctgctcctgtttatgctactgagcctgttcatagattaggtcttcttacaatgtatgatcagtttttatccagaaagcaagtatccgactttgatttgtttacactggatgacattgattctgctttccagaatgtgatcagattgacttactctcaaaattaccatctttctggaaagggagagggtattgtaattgctcctcatgttgctggacatatgctgggaggtagcatctggaggataacaaaggatggggaggatgttatatatgctgttgactacaatcatcggaaagaaaggcatttaaatggaactgttttacagtcttttgttcggcctgctgttctgataaccgatgcatatcatgctctttataccaatcaaaccgcaagacagcaaagggacaaagaatttctagataccatttcaaaacatcttgaagttgggggaaatgttctattacccgtggatactgcgggtcgagtcctggaacttctcttgatacttgaacagcattggtcacaaagaggtttcagctttcccatttactttctcacatacgtgtcatctagcacaattgactatgttaagagtttcctcgagtggatgagtgactccatttcaaagtcctttgagacttcacgtgataatgcctttctattgaggcatgtcactctcttgataaacaagactgatctggataatgctccacctggtccaaaggttgttcttgcttccatggccagtctcgaagcaggttttgctcgtgagatattcgtggagtgggcaaatgatcccagaaatttagtcctctttactgaaacagggcagtttggcactttagctcgcatgcttcagtcagccccacctcccaaatttgttaaagtcaccatgtctaagagggtccctttggctggggaagagttgattgcatatgaagaagagcaaaacagactgaaaagggaagaagctttgcgagctagcctcgtcaaagaggaggaaacaaaagcttcccatggatccgatgataattcaagtgaacctatggtcatagatacgaagactactcacgatgttgttggttctcacgggcctgcatataaagatatattgattgatggatttgttcccccatccagcagcgtagctccaatgttcccattttatgataacacatctgaatgggacgacttcggggagattataaatccagatgactacgtgatcaaggatgaagacatggaccgaggagcaatgcataacggaggtgatgtggacgggaggcttgatgaggcaactgctagtctcatgcttgatacaagaccttcgaaagtcatttccaatgagctcattgtgactgttagttgttcacttgttaaaatggactatgaaggtcggtcagatggccgctcaatcaagtctatgattgcgcatgtttctcctcttaaacttgttttggtgcacgcaatagctgaggctacagagcatttgaagcaacactgcttgaacaacatctgtccacacgtgtacgctcctcaaatagaggaaaccgtggacgtgacttctgatttatgtgcatacaaggtccaactttctgaaaagctgatgagcaatgtgatcttcaagaagctgggagattcagaagtagcttgggtggattctgaagtagggaagacagagagcgacatgaggtctctactaccgatgtcaggcgctgcttctccacacaaacctgttctagtgggtgatctgaaaatcgcagacttcaagcagtttctgtcaagcaagggtgttcaggtagaatttgcaggtggaggagctttacgttgtggtgaatatgtcactctacgaaaggttggcccgactggtcaaaagggaggagcatcaggtccacagcaaattctgatagaaggaccgttgtgtgaagactattataaaatcagggattatctctattctcagttctacctcctctgagcatatgatatagaaaaaaacgaagcttcttctcattttttctcaacacatttcaaccactcaacatgtaatctcgtatagttattgccttgcttttaaccccaatcttatagattaatgtgttaaaaaaggcaatagatgtttgtaatcttttttgtcttttgtcatcttagtagaag

SEQ ID NO: 4834 - DNA, 2411 bp, Arabidopsis thaliana
tagttcatcggagaaattttagggtttatatcggcgaacggaaaagatgggtacttcggtgcaagtgactcctctctgcggagtttacaacgagaatcctctctcctacttagtctccattgatggtttcaacttcctcatcgactgtggttggaacgatctcttcgacacatcgctcctcgaacctctctccagggttgcttctactatagatgcagttttgctttctcatccagatacacttcacattggtgctcttccttatgctatgaagcagcttggactctccgctcctgtttatgctactgagcctgttcatagattaggtctccttacaatgtatgatcagtttttgtccaggaagcaagtatccgactttgatctgtttacactggatgacatagattctgctttccagaatgtgatcagattgacttactctcaaaattaccatctttctggaaagggagagggtattgtaattgctcctcatgttgctggacacatgctgggaggtagcatctggaggataacaaaggatggggaggatgttatatatgctgttgactacaatcatcggaaagaaaggcatttgaatggaactgttttacagtcttttgttcggcctgctgttctgataaccgatgcatatcatgctctttataccaatcaaaccgcaagacagcaaagggacaaagaatttctagataccatttcaaaacatcttgaagttggaggaaatgttctattgccagtagacactgcgggtcgtgtcctggaacttctcttgatacttgaacagcattggtcacaaagaggtttcagctttcccatttattttctcacgtacgtgtcatctagcacaattgactatgttaagagtttcctcgagtggatgagtgactccatttcaaagtcctttgagacttcacgtgataatgcctttctattgaggcatgtcactctgttgataaacaagactgatctggataatgctccacctggtccaaaggttgttcttgcttccatggctagtctcgaagccggttttgctcgagagatattcgtggagtgggcaaatgatcccagaaatttagtcctctttactgaaacaggccagtttggcactttagctcgtatgcttcagtcagccccacctccaaaatttgttaaagtcaccatgtctaagagggttcctttggctggggaagagttaattgcatatgaggaagagcaaaacagactgaaaagggaagaagctttgcgagctagcctcgttaaagaggaggaaacaaaagcttcccatggatccgatgataattcaagtgaacctatgatcatagataccaagactactcacgatgttattggttctcacgggcctgcatataaagatatattgattgatggatttgttcccccatccagcagcgtagctccaatgttcccatattatgataacacatctgaatgggacgactttggggagattattaatccagatgactatgtgatcaaggatgaagacatggaccgaggagcaatgcataacggaggtgatgtggacggaaggcttgatgaggcaactgctagtctcatgcttgatacaagaccttcgaaagtcatgtccaatgagctcattgtgactgttagttgttcacttgttaaaatggactatgaaggtcggtcagatggccgctcaatcaagtcaatgattgcgcatgtttctcctttaaaacttgttttggtgcacgcgatagctgaggctacagagcatttgaagcaacactgcttgaacaacatctgtccacacgtgtatgctcctcaaatagaggaaacggtcgatgtgacttctgatttatgtgcttacaaggtccaactttctgaaaagctgatgagcaatgtgatcttcaagaagctgggagattcagaagtagcttgggtggattccgaagtagggaagacagagagggacatgaggtctctactaccgatgccaggtgctgcttcgccacacaaacctgttctagtaggtgatctgaaaatcgcagacttcaagcagtttctgtcgagcaagggtgttcaggtagaatttgcaggtggaggagctttacgttgtggtgaatatgtcactctacgaaaggttggaccgacgggtcaaaagggaggagcatcgggtccacagcaaattctgatagaaggaccgttgtgtgaagactattacaaaatcagggattatctctattctcagttctacctcctctgagcatgatatagaaaaaaaatgaagcttcttctcattttctcaacatttttcaaccactcaacatgtaatctcgtatagtttattgccttgcttataaccctcaaatcttatagattaatgtgttaaaaatggcaatagctttttg

SEQ ID NO: 4835 - DNA, 2519 bp, Arabidopsis lyrata
ctcttaggaattggttactcaacaataaaaaaagattcaatttcttttttataagtttataagattcctgttttgctaaatcaagattctttctaactgaagattctttctattagctattagttttatacaagagggaagaatctttcaactatcactccctacaaattccataagaaaattcacttatccgataaaaacttaaagaagaagaagaagaagaagaagaatggccacatgtcctcctttcgatttctctgccaaatattacgatggtgacggcggcggatgccagaggcagagcagcttcttcggaggcacgacggtgctcgatcaaggcgttggctacgccgtgattcttggttttggtgctttctttgccatcttcacatcttttttggtatggctagaaaaacgatatgtgggagctcgtcatacctcggaatggttcaatacagccggaagaaacgttaagacaggactcattgcaagtgtcattgtgtcacagtggacatgggctgcgaccatactgcaaagttcaaacgtagcatggcagtatggggttagtggaccgttttggtacgctagtggagccaccatacaggtgctgttgtttggtgtgatggcgattgagattaaaagaaaggctcccaatgctcacacggtctgcgaaatcgtgaaggctcgttggggaaccgcaacacatatagtgtttttggtgttttgtttggcgacaaacgtcattgtgacggcgatgctcttgctcggtggctcggctgtggtgaatgctcttaccggagtgaatctatacgctgcaagctttcttattcctctcggcgtcgttgtctatactttggccggaggacttaaagctactttcctcgcaagctacgttcactccgttatagttcacgtggctctagtcgtttttgtgtttctggtctacacatcgagtagtgagcttgggagtccgtccgtggtctatgaccgactaagagatatggtcgctaagtcaaggtcatgcaccgagccgctctcgcaccacgatcaagcttgcggtccggtggatggcaactacagaggctcctatctcaccatgttgagctctggcggcgctgtctttggtctcatcaacattgtcggaaacttcggcactgtcttcgtagacaatggttattgggtgagtgcaatagctgctcgaccttcatcaacccacaaagggtatttgcttggtggactcgtgtggtttgctgtacctttctctctagctacctcgttaggtctcggcgcactagcccttgacttgcctatatctaaggatgaggctgacagaggtttggttccgcctgccacagccattgctctcatgggtaaatcaggatccttgcttcttctcactatgctgttcatggctgtaacatcggctggttcttccgagctaattgcagtctcatcgctgttcacatacgacatctaccgaacatacataaaccctagagcaaccggtaaacaaatcttgagaatctcaagatccgcggttctaggatttggttgtttcatggggattcttgcagtggtctagaacaaagtctggtgtttcacttggatggatgtatctcgcatgggagtgctcattggttctgcggtcattcctatagctttcatgctcttgtggagtaaagccaatgcctttggtgcaattcttggatccacctcgggttgtgttcttgggatcattacttggctttctaccgcaaagatacagtacggacgcgttgatcttgacagcactgggaaaaatggccccatgttagctggtaacctcgtcgcaattctagcaggagggttgatccatgcggtgtgtagtctactccggccacaaaattacgattggtcgacgacgagggagatcaaagtagtggaagctgatgcttcaggggacgaagaagttgatgttccggccgaagaactaagagaagagaagcttagaagagccaaagcttggattgtgaaatggggtcttgtcttcactgtcctcattgttatcatttggccagttctctctctcccagcacgtgtgtttagtagaggatatttctggttttgggcaattgtggcggtagcttggggaactataggatccattgtgatcattggtttgccattggtcgaaagttgggacacgatcaagagtgtttgtatgggaatgttcacaaacgatagggtaatgaacaagcttgatgacttgaaccataggcttcgagctttaaccatggctgtaccagaagctgagaagatttatttgcttgaacttgagaagaccaagaaaaccgatgaagaacgttgaagaaatatcatattgggtacacaaaaggttaatgatactttctttttgtttatatgctttgtttggttgtcttttcttgtttgtgtgaatcatatcaaagctatctccgtttgtataatgtgttcaacatctttgaaaagtgtatgtattatacaaacaacagactgtgaaa

SEQ ID NO: 4836 - DNA, 2557 bp, Arabidopsis thaliana
tttcatcatcaataatggtaacaatttctaatttgtgtggatagtatcttatacgtcatgacaactcttgggaatggtaatttaaccatagaagagattcaatttctttttctaagtttattagattcctttgtttgctaaatcaagattctttcaagttgaagattctttctaatagtatatacaagagggaagaatctttcaactatcactccctacaaattccatgagaaaattcacttttccaatcaaaacgtaaagaagaagaggaagaatggctacatgtcctcctttcgatttctcgaccaaatattacgatggtgacggcggatgccagaggcagagcagcttcttcggaggcacgacggtgctcgatcaaggcgttggctacgccgtgattcttggttttggtgctttctttgccgtcttcacatcttttttggtatggttagaaaaacgatatgtgggagctcgtcatacatcggaatggttcaatacagcgggaagaaacgttaagacaggacttattgcaagtgtcattgtatcacagtggacatgggctgcgaccatactgcaaagttcaaacgtagcatggcagtatggggttagtggaccgttttggtacgctagtggagccaccatacaggtgctgttgtttggtgtgatggcgattgagataaaaagaaaggctcctaatgctcacacggtctgcgaaatcgtgaaggctcgttggggaaccgcaacacatatagtgtttttggtgttttgtttggcgacaaacgtcgttgtgacggcgatgctcttgctcggcggctctgctgtggtgaatgctctaaccggagtgaatctatacgccgcaagctttctcattcctctcggcgtcgttgtctatactttggctggaggacttaaagctactttcctcgcaagctacgttcactccgttatagttcacgtggctctagtcgtctttgtgtttctggtctacacatcgagtaaagagcttggcagtccgtccgtggtctatgaccgactaaaagatatggtcgctaagtcaaggtcatgcactgagccactctcgcaccacggtcaagcttgtggtccggttgatggcaactttagaggctcctatctcaccatgttgagctctggcggcgctgtcttcggtctcatcaacattgtcggaaacttcggcactgtcttcgtagataatggttattgggtgagtgcaatagctgctcggccttcgtcgacccacaaagggtatttgcttggtggactcgtgtggttcgctgtaccgttctctctagctacctcgttaggtctcggcgcactagcccttgacttgcctatatctaaggacgaggctgaccgaggtttggttccacctgccacagccattgctctcatgggtaaatcaggatccttgcttctactcactatgctatttatggctgtaacatcggctggttcttccgagctaattgcagtctcatcgctctttacatatgacatctaccgaacatacataaaccctagagcaaccggtagacaaatcttgaaaatctcaagatgcgctgttcttggatttggttgtttcatggggattcttgcagtggtcttgaacaaagctggtgtttcacttggatggatgtatctcgcaatgggagtactcattggttctgcggtcattcccattgctttcatgctcttgtggagtaaagccaatgcctttggtgcaattcttggagcgacctcgggttgtgtttttgggatcattacttggctaactaccgcaaagacacagtacggacgcgttgatcttgatagcaccgggaaaaatggccctatgttagctggtaacctcgttgcgattctaacagtccggccacagaattacgattggtcgacgacgagggagatcaaagtagtggaagcgtatgcttcaggggacgaagatgttgatgttcctgccgaagagctaagagaagagaagctgagaagagccaaagcttggattgtgaaatggggtcttgtcttcactatcctcattgttgtcatttggccagttctctctctcccagctcgcgtatttagcagaggatatttctggttttgggcaattgtggcaatagcttggggaactataggatccatcgtgatcattggtttgccattggtggaaagttgggacacgatcaagagtgtttgtatgggaatgttcacaaacgatagggtgatgaaaaagcttgacgacttgaaccataggcttcgagctttaaccatggctgtgccagaagctgagaagatatatttgcttgaacttgagaagaccaagaaaaatgatgaagaaggttgaagaaatatcatattgggtacacaaaaggttgatactctatttttgtttgtatgctttgtttggttgtcttttcttgttaatttgtgtgaaatcgcatcaaagctatctccgtttgtacaatgtgttcaacatctttgataagtgtatgtattatacaaacaacagacagtgaaagtttgaaaccatgattaatttagt

SEQ ID NO: 4837 - DNA, 2496 bp, Arabidopsis thaliana
caactcttgggaatggtaatttaaccatagaagagattcaatttctttttctaagtttattagattcctttgtttgctaaatcaagattctttcaagttgaagattctttctaatagtatatacaagagggaagaatctttcaactatcactccctacaaattccatgagaaaattcacttttccaatcaaaacgtaaagaagaagaggaagaatggctacatgtcctcctttcgatttctcgaccaaatattacgatggtgacggcggatgccagaggcagagcagcttcttcggaggcacgacggtgctcgatcaaggcgttggctacgccgtgattcttggttttggtgctttctttgccgtcttcacatcttttttggtatggttagaaaaacgatatgtgggagctcgtcatacatcggaatggttcaatacagcgggaagaaacgttaagacaggacttattgcaagtgtcattgtatcacagtggacatgggctgcgaccatactgcaaagttcaaacgtagcatggcagtatggggttagtggaccgttttggtacgctagtggagccaccatacaggtgctgttgtttggtgtgatggcgattgagataaaaagaaaggctcctaatgctcacacggtctgcgaaatcgtgaaggctcgttggggaaccgcaacacatatagtgtttttggtgttttgtttggcgacaaacgtcgttgtgacggcgatgctcttgctcggcggctctgctgtggtgaatgctctaaccggagtgaatctatacgccgcaagctttctcattcctctcggcgtcgttgtctatactttggctggaggacttaaagctactttcctcgcaagctacgttcactccgttatagttcacgtggctctagtcgtctttgtgtttctggtctacacatcgagtaaagagcttggcagtccgtccgtggtctatgaccgactaaaagatatggtcgctaagtcaaggtcatgcactgagccactctcgcaccacggtcaagcttgtggtccggttgatggcaactttagaggctcctatctcaccatgttgagctctggcggcgctgtcttcggtctcatcaacattgtcggaaacttcggcactgtcttcgtagataatggttattgggtgagtgcaatagctgctcggccttcgtcgacccacaaagggtatttgcttggtggactcgtgtggttcgctgtaccgttctctctagctacctcgttaggtctcggcgcactagcccttgacttgcctatatctaaggacgaggctgaccgaggtttggttccacctgccacagccattgctctcatgggtaaatcaggatccttgcttctactcactatgctatttatggctgtaacatcggctggttcttccgagctaattgcagtctcatcgctctttacatatgacatctaccgaacatacataaaccctagagcaaccggtagacaaatcttgaaaatctcaagatgcgctgttcttggatttggttgtttcatggggattcttgcagtggtcttgaacaaagctggtgtttcacttggatggatgtatctcgcaatgggagtactcattggttctgcggtcattcccattgctttcatgctcttgtggagtaaagccaatgcctttggtgcaattcttggagcgacctcgggttgtgtttttgggatcattacttggctaactaccgcaaagacacagtacggacgcgttgatcttgatagcaccgggaaaaatggccctatgttagctggtaacctcgttgcgattctaacagtccggccacagaattacgattggtcgacgacgagggagatcaaagtagtggaagcgtatgcttcaggggacgaagatgttgatgttcctgccgaagagctaagagaagagaagctgagaagagccaaagcttggattgtgaaatggggtcttgtcttcactatcctcattgttgtcatttggccagttctctctctcccagctcgcgtatttagcagaggatatttctggttttgggcaattgtggcaatagcttggggaactataggatccatcgtgatcattggtttgccattggtggaaagttgggacacgatcaagagtgtttgtatgggaatgttcacaaacgatagggtgatgaaaaagcttgacgacttgaaccataggcttcgagctttaaccatggctgtgccagaagctgagaagatatatttgcttgaacttgagaagaccaagaaaaatgatgaagaaggttgaagaaatatcatattgggtacacaaaaggttgatactctatttttgtttgtatgctttgtttggttgtcttttcttgttaatttgtgtgaaatcgcatcaaagctatctccgtttgtacaatgtgttcaacatctttgataagtgtatgtattatacaaacaacagacagtgaaagtttgaaaccatgattaatttagt

SEQ ID NO: 4838 - DNA, 1270 bp, Brassica rapa
aggaaaaacatgatggagtcatcggtttttaaacaagaccgacttctctctgtctcctttagacataagaacaagaacagagaccccttacatcttactagaatcaagaaaagtgaagaagcgaaagagagaagaagaaggtcggatgggagtggattactacaacgtcctccaagtcgatcgcaacgcctccgaagatgatctcaagaaagcttacagaaaactcgccatgaaatggcatcccgacaagaaccccaacaacaaaaaggacgccgaggccaagttcaagcagatctccgaagcttacgaggttcttagcgatccccagaagaaagctgtatacgatcagtacggcgaggaaggcttgaaagggaacgtcccacctccagatgctggtggagccacttacttctctaccggagacggtccaacgtccttccggttcaacccgagaagcgcagacgatattttcgccgagttctttggcttctccaggccatttggtggcggcggtggcggtggtacaagattctctagcagcatgtttggtgataacatttttgcctcttttggtgaagcaggaggaggaggaggagctatgcatcatggcggtggagccaggaaggcggctcctatcgaaaacaggctgccttgtagccttgaagatctctacaaaggaaccaccaagaagatgaagatctctagagaaattgctgacgtcagcggcaagacgatgccggtggaagagattctaacgattgatgtgaagccagggtggaggaaagggacaagaatcacattccctgagaaaggaaacgagcagcccggcgtgactccagctgatttagtcttcatcatcgacgagaagcctcacccggttttcactcgggagggtaatgacctcattgtcacacagaggatctcactcgctgaggccctgacaggctacaccgtgaacctgacgacactcgatggtcggagactgacaatcccagtcaccaacgtgatccaccccgagtacgaggaagtggttccaaaggaaggaatgcccttacagaaagatcagacaaagagaggaaacttgaggatcaagttcaagatcaagttcccaacgaggttaacctcagagcagaagacaggagtgaagaagcttctcggataacatgtcttgtttgtagatcagagagattgtgatttaatactgttgtatcctgtttggtcggatctgtaacataataaaatactcctaataaaatttgttttgtttgta

SEQ ID NO: 4839 - DNA, 1268 bp, Brassica napus
aagaacaagaacagagaccccttacatcttactagaatcaagaaaagtgaagaagcgaaagagagaagaagaaggtcggatgggagtggattactacaacgtcctccaagtcgatcgcaacgcctccgaagatgatctcaagaaagcttacagaaaactcgccatgaaatggcatcccgacaagaaccccaacaacaaaaaggacgccgaggccaagttcaagcagatctccgaagcttacgaggttcttagcgatccccagaagaaagctgtatacgatcagtacggcgaggaaggcttgaaagggaacgtcccacctccagatgctggtggagccacttacttcgctaccggagacggtccaacgtccttccggttcaacccgagaagcgcagacgatatattcgccgagttctttggcttctccaggccatttggtggtggcggtggcggtggtacaagattctctagcagcatgtttggtgataacatttttgcctcttttggtgaagcaggaggaggaggaggagcgatgcatcacggtggtggagccaggaaggctgctcctatcgaaaacaggctgccttgtagccttgaagatctctacaaaggaaccaccaagaagatgaagatctctagggagattgctgacgtcagcggcaagacgatgccggtggaagagattttaacgattgatgtgaagccagggtggaagaaaggcaccagaatcacattccctgagaaaggaaacgagcagcccggcgtgactccagctgatttagtcttcatcatcgacgagaagcctcacccggttttcactcgggagggtaatgacctcattgtcacacagaggatctcactcgctgaggccctgacaggctacaccgtgaacctgacgacactcgatggtcggagactgacaatcccagtcaccaacgtgatccacccagagtacgaggaagtggttccaaaggaaggaatgcccttacagaaagatcagacaaagagaggaaacttgaggatcaagttcaacatcaagttcccaacgaggttaacctcagagcagaaggcaggagtaaagaagcttctcggataacttctgtcttgtttgtagatcagagagattgtgatttaatactgttgtatcctgtttggtcggatctgtaacataataaaatactcctaataaaatttgttttgttgttatcaaaatccaaccatttctatagatgcaagagtgatgttgttcttaatcacatcctaaaaac

SEQ ID NO: 4840 - DNA, 1332 bp, Raphanus sativus
  misc_feature (573)..(573): n is a, c, g, or t
ggacaagacataaaaacaagaacaaagcccccttattgactcaccatacttcttagaatcaggaaaagtgaagaagcgaaagagagaagaagaagaaagtcggatgggagtggattactacaacgtcctccaagtcgatcgcaacgcctcagacgatgatcttaagaaagcttacagaaaactcgccatgaaatggcatcccgacaagaaccccaacaacaaaaaggacgcggaagccaagttcaagcagatctccgaagcctacgaggttcttagtgatccccagaagaaggctgtgtacgatcagtatggcgaggaaggcttgaaagggaacgtccctcctccagatgctggtggagccacttacttctctaccggagacggtccaacttccttccggttcaacccgagaagcgcagacgatgtatttgccgagttctttgggttctccgggccgtttggtggtggtggtggtggtacaagattctctagcagcatgtttggagataacatctttgcctctttcggtgaaggaggaggaggaggaggagctatgcatcatagtgtacccangaaggcggctcctatcgaaaacaagctgccttgtagccttgaagatctctacaaaggaaccaccaagaagatgaagatctcgagggagattgctgatgtcagcgggaagacgatgccggtggaagagatattaacgattgatgtgaagccagggtggaagaaaggcacaagaatcacattccctgagaaaggaaacgagcaacccggtgtcactccagctgatttagtcttcatcatcgacgagaagcctcacccggttttcactcgggagggcaatgacctcgtagttacacagaagatctcgcttgttgaggccttgaccggctgcactgtgaacctgacaacactcgatggtcgaagactgacaatcccagtcaccagtgtgatacacccagagtacgaggaagtggttccaaaggaaggaatgccgttgcagaaagatcagacaaagagaggaaacttgaggatcaagttcaacatcaagttcccaacgagattaaccttagagcagaagacaggagtaaagaagcttcttggataaattgagctgttatcagtgagtaacataccagtcaaaagcaatgtagaacagaggaagagaaagatttaagcttctgtcatgtgtcgatcagagagattgtgattattactgttgtatcctttttggtcgatctgtaataaaatactcgtaataaaatttgtttgttgtaatctaaatcaccattcctatagatgcaagagtactattgtttttaatca

SEQ ID NO: 4841 - DNA, 1432 bp, Arabidopsis thaliana
aacgttccacagaattctccacaactctgagaagaaacatcatgaatccgtcgtttttaagaccaaaactcatctaatcttcaacaaaagactatcaaaagaagaaacagagcaaatttcattctctcagaacaaatatatacatattaatcagaatcaggaaaagtgaagaagcgaaagagagaagaagatcggatgggagtggattactacaaagtcctccaagtcgatcgcagcgcaagcgacgatgatctcaagaaagcttatcgtaaacttgccatgaaatggcatcccgacaaaaatcccaacaacaaaaaggatgccgaagctatgttcaaacaaatatccgaagcttacgaggtactaagtgatcctcagaagaaagctgtgtatgatcaatatggtgaggaaggtttgaaagggaacgtgccacctccggatgcaggtggagctacttacttctctaccggggatggtccaacgtccttcaggttcaacccgagaaatgcggatgatatatttgctgagttctttggcttctctagcccatttggcggcggaagaggtggtacaagattctctagcagcatgtttggtgataatatgtttgcttctttcggcgaaggaggaggcggtggtggtggctcgatgcatcacggtggagctaggaaggctgctcctatcgaaaacaagttgccttgtagccttgaagatctttacaaaggaaccaccaaaaagatgaggatttctagggagattgctgatgtcagtggcaagacgatgcaggtggaagagattttgaccattgatgtgaaaccaggatggaagaaaggcacaaagatcacgttcccagagaaaggcaatgagcaacccggtgtgattccagcggatttagtcttcataatcgacgagaagcctcacccggttttcactcgagagggtaacgacctcatagtcacacagaagatctcacttgttgaggccttgactggttacacagtgaacctgactactcttgatggtcggagactgacaattccagtcaccaacgtggtccatcccgagtacgaggaagtggtaccgaaggaagggatgccattgcaaaaagaccagactaagagaggtaacttgaggatcaaatttaacatcaagttccctacaaggttaacctcagagcagaagacaggagtgaagaaacttctcggatgaaatgagttatagtcagcacatttcagacaaaacaatgttgaacagaagaggaacaagaaaatcatgttgcagaccacagggattgtgattaaatactgttgtgacctttttgatcgatttgtaacatatgtacgattggatacctcctaataaatttgttactttctctataatcaaaacgcttctaaatccatacctataaatgcaagagcgttgctgtttc

SEQ ID NO: 4842 - DNA, 1449 bp, Arabidopsis lyrata
aacattccacagaattctccagactctgagaagaaacatcatgaatccgccgtttttaagaccaaactcttgtaatcttcaactaagaactatcataataaatccagaagaaacagagcaaatttcattttttctgaacaatatatcaataagaatcaggaaaagtgaagaagcgaaagagagaagaagaagaaggtcggatgggagtggattactacaaagtcctccaagttgatcgcaacgcaagcgacgatgatcttaagaaagcttatcgtaaactcgccatgaaatggcatcccgacaaaaatcccaacaacaaaaaagacgccgaagctatgttcaaacaaatctccgaagcttacgaggtactaagtgatcctcaaaagaaagctgtgtatgatcaatatggtgaagaaggtttgaaagggaatgtgccacctccagatgctggtggagctacttatttctctaccggggatggtccaacgtctttccggttcaacccgagaaatgcggatgatatatttgctgagttctttgggttctctagtccatttggtggtgctggcggaagaggtggtacaagattctctagcagcatgtttggtgatgatatatttgcttctttcagcgaaggaggaggcggtggtggtggctcaatgcatcacggtggagctaggaaggctgctcctatcgaaaataagttgccttgtagccttgaagatctttacaaaggaaccaccaagaagatgaggatctctagggagattgctgatgtcagtggcaagacaatgcaagtggaagagattttgaccattgatgtgaaaccagggtggaagaaaggcacaaagatcacattccctgagaaaggcaatgagcaacccggtgtgattccagcggatttagtcttcatcatcgacgagaagcctcacccggttttcactcgagagggtaacgacctcgtagtcacacagaagatctcacttgttgaggccttgacaggctacacagtgaacctgactacacttgatggtcgaagactgacaatcccagtcaccaacgtgattcatcctgagtatgaggaagtggttccaaaggaaggaatgccattgcagaaagaccagactaaaaaaggaaacttgaggatcaaattcaacatcaagtttcctacaaggttaacctcagagcagaagacaggagtgaagaagcttctcggctaaattgagttataattagaagattccggacaaggggatgtaaacagaagaagaacatcaaagcttctttatatcatgttggagatggcagagattgtgattaaatactgttaagacctttttgatcgatttgtaacatatgtgcgattggatacatcctaataaatttgttgctttctctataatcaaaacgcttctaaattcgtacctataaaggcaagagcattgttgt

SEQ ID NO: 4843 - DNA, 1490 bp, Arabidopsis lyrata
gataataaaagaagaaaaaaggaaacaaatggagaagggaagaggcaagagggcaaagctgtgattaaaacaccgtcaacggagacaaacaaagatcgtgttttctcgaaccttccacgaggttctttactaagccaaagcagaagagaccagagaacgaagaagaaatccagaaattaccaatttctttttttgtttaatcggattcaggaaaagtgaagaaacgtaagagagaagaagaagaaggtgagatgggagtggattattacaaggttttacaggttgatagaagcgctaacgacgatgaccttaagaaagcttatagaaaactcgctatgaaatggcatcccgacaagaaccctaacaacaaaaaagacgctgaggctaagttcaagcagatctctgaagcctacgatgttcttagcgatcctcaaaagagagcggtatatgatcaatacggtgaggaagggttaaaagggaatgtgccacctcccaatgctggtggtggagcctcatacttctcaacaggagatggaccttcatctttcagattcaacccgagaagtgcggatgatatattcgctgagtttttcgggttctcgaccccgtttggtggtggtggtggagggcagagattcgctagccgcatgtttggtgatgatatgtatgcctcttttggtgaaggagcaggtggtggaggagctatgcatcatcatcaccatcatcatcatcacggtgcagctaggaaagtggctcctatcgagaacaagttgccttgtagccttgaagatctctacaaaggaactaccaagaagatgaagatctccagggagattgtagatgtcagcggcaaggcaatgcaagtggaagagattctaacgattggagtgaaacccgggtggaagaaaggcacaaagatcacattcccagagaaaggcaatgagcatccaggtgtgattccagcagatctagtcttcatcattgacgagaaaccccatccagtgtttacccgcgagggcaacgacctgattgtcacacagaaagtctcactagctgatgccttaacaggctacaccgcaaacataacgacccttgatggtcgtacacttacaatcccaatcacaaatgtgatccatccagagtatgaagaggtggttcctaaagagggaatgccacttcagaaagatcagacaaagaaagggaacttaaggatcaagttcaatatcaagtttccagcgagattaactgcggaacagaaagctgggtttaagaagcttattgggtgatgattaaagcttctctgtcttatgatgtgtggagattgggttaaatttggtaatatacgatttatatagggaattctctccctcttcattaatttcgtgttgttaaacaagtcttctttttaaagaatagttatttcaagatttggtacatgtcttccataaacaaaaattgaagatcacaaatcttttgttttacaaaagttt

SEQ ID NO: 4844 - DNA, 1544 bp, Arachis hypogaea
agggggaaccatacttcgaacacctccctgaaatgtcaccatacccataaacccacacggaaaccaagcgctctgaatccccccaccgcagaaaaacagaggaagaagaaagaaagaaagaaagagagaaagagagaagaacatcaaccgccaccgaacatgggcgtggactattacaaggtcttgcaggttgatagaaatgccaccgaagatgacctcaagaaagcttacagaaagctcgccatgaaatggcaccccgacaagaaccccaacaacaaaaaagaagctgaagccaagttcaagcaaatctccgaagcatatgatgtgctgagtgatcctcagaagagagcaatctatgaccaatatggggaagaaggtttgaagggtcaggttccaccacctgatgctggttctggtggcggtggatccaccttcttttccaccagtgacatcccggggtcgtttcggttcaatcctcgaaacgccgatgacatttttgctgagttttttgggttttcaagcccctttggtggcatgggaaggagcagtggcggtggcatgagatcaaggttccctaatgggatgtttggtgatgacatgtttgcatcttttggtgaaggaggtggtggagcaggggtgcacatgagtcaaggtggtccacgcaaggctccccctattgagaacaagcttccctgcacccttgaggacatatataaaggcaccactaagaagatgaagatctccagggaaattattgatgctagtggcaaaaccatgccagtggaggagatcttgacaattaatgtcaagcctggttggaagaaaggaacaaagatcaccttcccggagaaaggaaacgaacaaccaaatgtaacgcctgcagaccttgttttcattatcgatgagaaaccacacagcgtcttcactcgtgaaggaaatgatctgatcacaactcagaagatttctctcgtggaggctctaaccggatacacggtaaaccttacgacgttggatggtagaaacttaaccatacccatcaacagtgtcatccatccagattatgaggaggtcgtcccaagggaagggatgccgcttccaaaggatccgtcaaagaaaggaaacttgaggatcaaattcaacatcaagttcccaagtcggctcagcgccgaccagaaatctggaatcaagaaactcctggctggttgaaacattgagtacttggcagtccagcggctttagtttatgaaaatgtacattagttacaacaatcttgagaggaggcaaatggaaataatttggtttggttggttatcatcatatatgtattctggaatttggaacatagtatagtgattgaaatttttggttagatgctatcctcttcctgtatgattgcttattaactgctgaaaagaatagctttctattataactagcaactagcagttgatgtggcagcaacttagaaaacgttttccttccaaatttggatcaacagttgaacattaaccacatttgtgcaggaagatttagttagtttaatt

SEQ ID NO: 4845 - DNA, 2241 bp, Raphanus sativus
  misc_feature (453)..(453): n is a, c, g, or t
  misc_feature (463)..(463): n is a, c, g, or t
  misc_feature (473)..(473): n is a, c, g, or t
  misc_feature (1009)..(1009): n is a, c, g, or t
  misc_feature (1138)..(1138): n is a, c, g, or t
  misc_feature (1144)..(1144): n is a, c, g, or t
  misc_feature (1186)..(1186): n is a, c, g, or t
  misc_feature (1395)..(1395): n is a, c, g, or t
  misc_feature (1400)..(1400): n is a, c, g, or t
  misc_feature (1418)..(1418): n is a, c, g, or t
  misc_feature (1544)..(1544): n is a, c, g, or t
  misc_feature (1634)..(1634): n is a, c, g, or t
  misc_feature (1643)..(1643): n is a, c, g, or t
  misc_feature (2089)..(2089): n is a, c, g, or t
gggtctcgctcgattccaggaagctacacttggtttcattttgcatgtggtgaacaatggatactgagtcttggaagtttctcagaagtgtttgcttactttctttcctccttggttcttgctttctctatcaaagccttcatgttgctatagctgctcaagagcaagatacaacgcaaccatccgtgactttgcaagttaatgattctaatggagttggacgactcattcctgatactctcttcgggatcttcttcgaggagataaaccatgctggtgctggtggattatgggctgaacttgttagcaacagagggtttgaagctggtgggcagaacacaccttctaatatatggccttggtccattgttggtgatcaatcatctatatatgtttctacggaccgttcatcatgctttgaacggaataaaatcgctttgggaatggatgtgntctgtgatancaatggttgnccatcagtggtgttggagtttataaccctggttactggggcatgaatattgaagaaggaaagaagtacaaggtggcgttttatgtgcgttcaactggtgatattgatctctctgtgtcgttgacaagctcgaatggttcgatgactcttgcttctgagaagatcatagcgtcagcttctgatgtttcgaaatggactaagaaggaggttcttcttgaggcacaagggaaggatcatggtgcaaggcttcagttaacaacaaccaagaaagggtcaatatggattgaccaagtctctgccatgccggtggatacttacaagggacatggctttagaaacgatctttaccagatgatggttgatataaaaccccgcttcatccgtttcccaggtggttgttttgtggagggtgaatggttaagtaatgcattccgctggaaagaaactgttggtccttgggaagagagaccgggacactttggtgatgtttggaagtattggaccgatgatggccttggccacttcgagttctttcanttagcagaagacattggagcagcaccaatatgggtgtttaacaacgggattagtcacaatgatgaagttgaaactgccagtatcatgccctttgttcaagaagcacttgatggtattgagtttgctagnggagangctaactctacatggggatcggttcgagctgcaatgggacgncaggagccttttgaactgaagtatgttgctattgggaatgagattgtggaaagacttactacagagggactacattgtgttctatgatgctatcaaaaaggcttacccagatatcaaaatcatctccaactgtgatggatcatctagtccgcttgaccatcctgctgattactatgatttccatatatacacttctgctagcagtttgntttcnatgtatcatcaatttganggcacttcacgcaagggtccaaaggcttttgtcagtgaatatgctgtgactggaaaagatgctggtacaggaagccttctcgccgctcttgcagaagctgcatttctcattggtcttgaaaagaanagtgacattgtggaaatggcgagctatgcaccgctctttgtgaacacaaacgatagacggtggaaccctgatgcaatagtcttcaattcntctcatctntatggaactcctagctattgggtgcaacggttctttgcggagtcaagcggatcgactctcctctcttcagaacttaagggaaactcttcttctcttgtagcatctgcaatctcctggaaaaacagtagccaagagtacatacgcataaaggctgtaaactttggagatacctcagtaaacctgaaggtgttggttactggattggatccgaacgtgatgaaagttgcaggatcaaagaggacagtacttacatctacaaatgtgatggatgaaaactccttcacacagccggagaaggttgtgccacaagaaagcttgctagagatggctgaggaggatcttaccgttgttctcccgccacactcgttctcttcatttgatttgttgaaggaatctgcaaagataagaaagccagtttctgattcttcctcttcccagccgtgtgntgagacacaatgatatggtgacagggagtattagaaaacttcatgttaaaggtctcttgtggttaaaaatatataaattatgtatgcgtacccatgtgtagaaagggataaatagattggtgaataaaagctagtttctttaatcaaaaaaa

SEQ ID NO: 4846 - DNA, 1772 bp, Brassica napus
gatagtattaaacaattgttttggttcttggtactgatatttgatacttatcagtaatctggaatctagtcgttttttattaagtttatggagaagaagctgcttcttattatataaataagttggaaatgctataaaataacaagctaagcggtcattcttattagagactcatagcatttaacaattgttttggattcttggtactgatatttgatacttatcagtaatctggaatctctagtcgtttttatcaagtttaagtttatggagaggaagctgcttcttacagtgtcgatcatcatgaatcttgtatttactattcatattctttatagaaactcaaccacatggaatccgacttggaccagtagagctgctattgaagcagaggatgcagcctctgtgtcatgctcaggccatggaagagcttacgtggacggtattggagtccttggcggcaagcaaccttcttgtgaatgcaacaattgctatacaggcaaagattgttctattcttctctcagattgtcctgtcaacgctaactcaggagaccctttgttcttagagcctttctggatgcgacaagcagagagcagcgcggctctggtctcgggatggcacaggatgagttatatctatcaagatgggacatatatgtcggaagcgcttgagacggtcatcaggaaactgcatagtgtggtgggaaacgctgttacagataacaggtttgtaatatttggaagtggaagcacacaattgcttgcagcagctgttcatgccttgtctttgacaaactcatcatcatcaggaccggcaaggcttttggcttcagttccatattacgctatgtacaaggagcaagcggagttctttgactcagtacatctcaagtttgaaggagatgcgtttgcgtggaagaatagcgagcgcaatgataataccacacaagttatagaggtagtgacatctccgaataatccagatgggaagctgaaaagagcggttcttgatggtcctaatgtcaaaacaattcatgattacgcctattactggccttatttctcccctataactgttccagctgatgaagatttgagcttgtttagtctctccaagactacaggtcatgctggctctagattcgggtggggattggtaaaagacaaaactgtttatgaaaatatgaaaagatatatcactttgagtagtatgggagtttctaggacaacacagcttcatgttcttcaactgctcaacgtagtagttagggatggaggcgataatatattccattttggtcatgaaactttgaagaaaagatgggagacagtgaacaaggtcttgtcactctctacacgtttctcgctccagaaaatcaaacctgagtactgcaactatttcaagaaagtcagagactttgctccttcttatgcatgggtgaagtgtgaaaggccaggagacgcaaactggtatgagatattcagagaggccaagataacaggacgtgatggcaaagtgtttggatcagaggaaagttttgtgagattgagtctaatcagatcacaagatgactttgatcatcttattgatatgttgaagaagttagtcttacaagaaggtgtagaagctcattctatctgaaaacttgatgttatcaacaaatgtctttaattcaatattatgtagtaacgtatttgtgcgactataattaagcctacaatgcccgttgtatgaaacctttgtaaatattgcgaaaatcagtcccaacg

SEQ ID NO: 4847 - DNA, 1794 bp, Brassica napus
  misc_feature (1071)..(1074): n is a, c, g, or t
  misc_feature (1155)..(1155): n is a, c, g, or t
  misc_feature (1212)..(1212): n is a, c, g, or t
  misc_feature (1230)..(1230): n is a, c, g, or t
  misc_feature (1333)..(1333): n is a, c, g, or t
gatagtattaaacaattgttttggttcttggtactgatatttgatacttatcagtaatctggaatctagtcgttttttattaagtttatggagaagaagctgcttcttattatataaataagttggaaatgctataaaataacaagctaagcggtcattcttattagagactcatagcatttaacaattgttttggattcttggtactgatatttgatacttatcagtaatctggaatctctagtcgtttttatcaagtttaagtttatggagaggaagctgcttcttacagtgtcgatcatcatgaatcttgtatttactattcatattctttatagaaactcaaccacatggaatccgacttggaccagtagagctgctattgaagcagaggatgcagcctctgtgtcatgctcaggccatggaagagcttacgtggacggtattggagtccttggcggcaagcaaccttcttgtgaatgcaacaattgctatacaggcaaagattgttctattcttctctcagattgtcctgtcaacgctaactcaggagaccctttgttcttagagcctttctggatgcgacaagcagagagcagcgcggctctggtctcgggatggcacaggatgagttatatctatcaagatgggacatatatgtcggaagcgcttgagacggtcatcaggaaactgcatagtgtggtgggaaacgctgttacagataacaggtttgtaatatttggaagtggaagcacacaattgcttgcagcagctgttcatgccttgtctttgacaaactcatcatcatcaggaccggcaaggcttttggcttcagttccatattacgctatgtacaaggagcaagcggagttctttgactcagtacatctcaagtttgaaggagatgcgtttgcgtggaagaatagcgagcgcaatgataataccacacaagttatagaggtagtgacatctccgaataatccagatgggaagctgaaaagagcggttcttgatggtcctaatgtcaaaacaattcatgattacgcctattactggccttatttctccccnnnnactgttccagctgatgaagatttgagcttgtttagtctctccaagactacaggtcatgctggctctagattcgggtggggnttggtaaaagacaaaactgtttatgaaaatatgaaaagatatatcactttgagtagnatgggagtttctaggacnacacagcttcatgttcttcaactgctcaacgtagtagttagggatggaggcgataatatattccattttggtcatgaaactttgaagaaaagatgggagacantgaacaaggtcttgtcactctctacacgtttctcgctccagaaaatcaaacctgagtactgcaactatttcaagaaagtcagagactttgctccttcttatgcatgggtgaagtgtgaaaggccaggagacgcaaactggtatgagatattcagagaggccaagataacaggacgtgatggcaaagtgtttggatcagaggaaagttttgtgagattgagtctaatcagatcacaagatgactttgatcatcttattgatatgttgaagaagttagtcttacaagaaggtgtagaagctcattctatctgaaaacttgatgttatcaacaaatgtctttaattcaatattatgtagtaacgtatttgtgcgactataattaagcctacaatgcccgttgtatgaaacctttgtaaatattgcgaaaatcagtcccaacgataaactgatactatcatacta

SEQ ID NO: 4848 - DNA, 1603 bp, Arabidopsis thaliana
gtaattgatccccaccttttatacaaacaaaaagttgaagctgaattttttttgcaggttttaagtaaagatgatgcagaagaagctacttcttatagtatcaatcatcttgaatctcgtattcaccattcatattctttattatagttcaaccacatggaatccaacgtggaccaacagagctgcagcggaagcagaaactgtagcctctttttcatgctcaggccacggcagagcttttgtggatggtcttggtgtccttgacggccagaaacctccttgtgagtgcaacaattgctacataggaaaagattgctccgttcttctcaaagattgtcctgtcgatgctaactcaggagaccctttgttcttggagcctttctggatgcgacaagcagagagaagcgcgattttggtctcgggatggcacaggatgagttatatatacgaagatgggacatatgtgtctcgagagctcgagaaggtcattagaaaacttcatagtgtagtgggaaatgcagttacagataacagattcgtaatctttggatctggtaccacacaattgcttgcagcagctgttcatgccttgtctttgacaaactcatcagtatcatcacctgcaagacttctgacttctattccatactatgctatgtacaaggaccaagcagagttttttgattcagcacatctcaagtttgaaggaaatgcgtctgcgtggaagcagagcggacgcaatgataatatcacacaagttatagaggtggtgacatctccgaataatccagatgggaaattgaaaagagcggttcttgatggtcctaatgtgaaaacacttcatgattatgcttattactggcctcatttctcacctattacacatccagttgatgaagatttgagcctgtttagtctctccaagactacaggtcatgctggttcaagattcgggtggggattggtaaaggacaaagctatttatgaaaaaatggatagatttatacgtttaactagtatgggagtttctaaagaaacacagcttcatgttcttcagttgctcaaagtagtagttggtgatggaggcaatgagatattcagttttggttatggaactgtgaagaaaagatgggagacactgaacaagatcttctccatgtccacgcgtttctcgctccagacaatcaaacctgagtactgcaactatttcaagaaagttagagagtttactccttcttatgcatgggtgaagtgtgagagaccagaagacacaaactgctatgagattttcagagcggcgaagataacaggacgcaatggcaatgtgtttggatcagaagaaaggtttgtgcgattgagtctcatcagatcacaagatgactttgatcagcttattgctatgttgaagaagttagtttaccatgaggaagatgttccttctgaaaactttatgtatatttaggcctctttgttaaagcctagcgcttagtccaattctataaaacctcaatacgtatttctgattttgtaaagctttttgtaaatttcgtgggcttgtaattatttcaatttctatcagaatctttcatttcggttcggttta

SEQ ID NO: 4849 - DNA, 884 bp, Brassica napus
acagcagaaggagaagaggaagatgaagctgaaagtgtatgcagatcgtatgtcacagccgtctcgtgctgtaatcatattctgcaaggttaatggaatcgaattcgatgaggttctgattatcttggcgaagcgtcagcaattatcccctgaattcaaagagattaacccattggggaaagttccaactattgttgacggcagacttaagctcttcgagagtcacgccatcttgatttatctttcctctgcattcccgagtgtagctgatcattggtacccgaatgatctttccaagagagccaagattcactctgtcttggattggcatcactccaatttacgccctggtgcagctggatatgtaatgaatagtgttctagctccatttcttggcggttctctggactcgaaagcagctgctgaagctgagcagatactaaccaagtctctgtccactctagagactttttggcttaagggcaatgctaaattcttgctcggaagcaaccaaccatccatagctgatctcagccttgtatgcgaacttatgcaactccaggttttggatgagaaagatcgtcttagattgttttctccttacaagaaagttgaggaatggattgagaatacgagaaaggccacgcagcctcactttgatgtggttcataaaaccctttacggagctaaagacaaatttgagaaacagcggaagatggggacaacaaccgtatctaaacctggttttcaatctaagatgtgagaacaaatttgtatcggaggctgtttgtgaaaaccccggtttaggggatcactgtaataactcggttcaacatttacactgtaatcggaaccaaggaatgtatttgtaatcacttatcagg

SEQ ID NO: 4850 - DNA, 924 bp, Brassica napus
  misc_feature (913)..(913): n is a, c, g, or t
atccacacagcagaaggagaagaagaagatgaagctgaaagtgtatgcagatcgtatgtcacagccgtctcgtgctgtaatcatattctgcaaggttaatggaatcgaattcgatgaggttctgattatcttggcgaagcgtcagcaattatcccctgaattcaaagagattaacccattggggaaagttccaactattgttgacggcagacttaagctcttcgagagtcacgccatcttgatttatctttcctctgcattcccgagtgtagctgatcattggtacccgaatgatctttccaagagagccaagattcactctgtcttggattggcatcactccaatttacgccctggtgcagctggatatgtaatgaatagtgttctagctccatttcttggcggttctctggactcgaaagcagctgctgaagctgagcagatactaaccaagtctctgtccactctagagactttttggcttaagggcaatgctaaattcttgctcggaagcaaccaaccatccatagctgatctcagccttgtatgcgaacttatgcaactccaggttttggatgagaaagatcgtcttagattgttttctccttacaagaaagttgaggaatggattgagaatacgagaaaggccacgcagcctcactttgatgtggttcataaaaccctttacggagctaaagacaaatttgagaaacagcggaagatggggacaacaaccgtatctaaacctggttttcaatctaagatgtgagaacaaatttgtatcggaggctgtttgtgaaaaccccggtttaggggatcactgtaataactcggttcaacatttacactgtaatcggaaccaaggaatgtatttgtaatcacttatcagggctgtttcaaaataaacatatangtagacctaga

SEQ ID NO: 4851 - DNA, 770 bp, Brassica rapa
  misc_feature (710)..(710): n is a, c, g, or t
atccacacaactgaaagataagaagaagatgaagctgaaagtgtatgcagatcgtatgtcacagccgtctcgtgctgtaatcatattctgcaaggttaatggaatcgaattcgatgaggttctgattatcttggcgaagcgtcagcaattatcccctgaattcaaagagattaacccattggggaaagttccaactattgttgacggcagacttaagctcttcgagagtcacgccatcttgatttatctttcctctgcattcccgagtgtagctgatcattggtacccgaatgatctttccaagagagccaagattcactctgtcttggattggcatcactccaatttacgccctggtgcagctggatatgtaatgaatagtgttctagctccatttcttggccgttctctggattcgaaagcagctgctgaagctgagcagatactaaccaagtctctgtccactctagagaccttttggcttaagggcaatgctaaattcttgctcggaagcaaccaactatctatagctgatctcagccttgtatgcgaacttatgcaactccaggttttggatgagaaagatcgtcttagattgttttctccttacaagaaagttgaggaatggattgagaatacgagaaaggccacgcagcctcactttgatgtggttcataaaaccctttacggagctaaagacaaatttaganaacagcggaagatgggaacaacaaccgtatctaaacctggttttcaatctaagatgtgag

SEQ ID NO: 4852 - protein, 261 aa, Arabidopsis lyrata
MVMDSSKWWWIGNHNTTNFSPWLHSTLSELDEKTKEMLRVIDEDADSFAARAEMYYKKRPELIAMVEEFYRSHRSLAERYDLLRPSSVHKHGSESHGKSSTCDESSWSEACETHEDYAESEIDNGESKWVDEGEIDGIVEEMESSQVEYGEASGSYEMMKEELERLREENKVYSEMVREKDEEKREAIRQMSVAIQMLKEENSELKQRVTTVVARRNKVGGDSQRKPFEFKKINLQGFWGKVVGNWVLPNTDSASRELMTL

SEQ ID NO: 4853 - protein, 307 aa, Arabidopsis lyrata
MRRINSLYGRIGMLRRVPEESTKKSHTLLASLSFSTEGSYGGDGELQQNSSKVKIFDRDLKRIHRDRAAWLSRQKNDSFVDAVAENLLDRLEDCKKSFPTAFCLGGSLGAVKRLLRGRGGIEKLIMMDTSYDMIKSCRDAQEDSLDNSIETSYFVGDEEFLPVKESSVDLIISSLGLHWTNDLPGSMIQCKLALKPDGLFLAAILGGETLKELRIACTLAHMEREGGISPRLSPLAQVRDAGNLLTRAGFSLPGVDVDEYVVKYKSAMDLIEHLRAMGETNALLERNKAGFFLYFESRNCSGHGSHI

SEQ ID NO: 4854 - protein, 368 aa, Raphanus sativus
  misc_feature (142)..(142): Xaa can be any naturally occurring amino acid
FPGEAREDSMYGRIGSLKRVLEKPRKQSHTLLPFLSFSTEDGSGYGGGGGGGGESQQQNSSSRVKIFDRDLKRVHRDRAAWLSRNKNDTFVDAVAENLLDRLEDCKKSFPSALCLGGSLGAVQRLLRARGGIEKLIMMDTSXDMIKSCRDAAQHDVSLGNSSIDTSYLVGDEEFLPIKESSVDLIISSLGLHWTNDLPGSMIQCKLALKPDGLFLAAILGGETLKELRIACTLAHMEREGGISPRLSPLAQVRDAGNLLTRAGFSLPGVDVDEYVVKYKSALDLIEHLRAMGETNALLQRNKILNRETALATAAIYDSMFATEDGTIPATFQVIYMTGWREHTSHPQAKRRGSATVSFTDIHKQFGGQ

SEQ ID NO: 4855 - protein, 168 aa, Raphanus sativus
MIQCKLALKPDGLFLAAILGGETLKELRIACTLAHMEREGGISPRLSPLAQVRDAGNLLTRAGFSLPGVDVDEYVVKYKSALDLIEHLRAMGETNALLQRNKILNRETALATAAIYDSMFATEDGTIPATFQVIYMTGWREHASHPQAKRRGSATVSFTDIHKQFGGQ

SEQ ID NO: 4856 - protein, 406 aa, Arabidopsis lyrata
MQAIGSSHGRRLCFNHYLSDSFSKFLSPSSSPSLLPQRCHSFCIPKLGSSSINENGRGRIVTVRASGEEDSNGNFAPLAPVELESPVGQLLEQILRTHPHLLPVTVDEQLEKFAAENETLKADSSATQDILQKRISEVRDKERRKTLAEIIYCLVVQRFVEKGISMIPQIKPTSDPAGRIDLWPNQEEKLEVIHSADAFEMIQSHLSSVLGDRTAVGPLSSIVQIGKIKLGKLYAASAMYGYFLRRVDQRYQLERTMNTLPKRPEKTRERFEEPSPPYPLWDPDSLIRIQPEEYDPDEYAIQRNEDESSSYGLRSYVTYLDSDTLQRYATIRSKEAMTLIEKQTQALFGRPDIRILEDGKLDTSNDEVLSLSVSGLAMLVLEAVAFGSFLWDSESYVESKYHFLKA

SEQ ID NO: 4857 - protein, 402 aa, Brassica napus
MQAIGSYGCLCFKHYHSLSKFLSPPSTSPSLLPQRCHSFCIPKLGSSSNNAENGRGRGVTVRASGEDDNFAPIAPVELESPVGQLLDQILRTHPHLLPVTVDQQLDKLSTENDNLKAESSSSQDILSKRISEVKDKEKRKTLAEIIYCLVVHRFVEKEITMIPQIKPTSDPAGRIDLWPNQEEKLEVIHSAEAFEMIQSHLSSVLGDRTAVGPLSSIVQISKIKLGKLYAASVMYGYFLRRIDQRYQLERTMNTLPKRPDKTRERYEEPSPPYPLWDPDSLIRIQPEEYDPDEYAIQRNEEESSSSYGLRSYVTYLDSDTLQRYATIRSKEAMSLIEKQTQALFGRPDIRILEDGKLDTSNDEVLSLSFSGLAMLVLEAVTFGSFLWDAESYVESKYHFLKA

SEQ ID NO: 4858 - protein, 402 aa, Brassica napus
MQAIGSYGCLCFKHYHSLSKFLSPPSTSPSLLPQRCHSFCIPKLGSSSNNAENGRGRGVTVRASGEDDNFAPIAPVELESPVGQLLDQILRTHPHLLPVTVDQQLDKLSTENDNLKAEPSSSQDILSKRISEVKDKEKRKTLAEIIYCLVVHRFVEKEITMIPQIKPTSDPAGRIDLWPNQEEKLEVIHSAEAFEMIQSHLSSVLGDRTAVGPLSSIVQISKIKLGKLYAASVMYGYFLRRIDQRYQLERTMNTLPKRPDKTRERYEEPSPPYPLWDPDSLIRIQPEEYDPDEYAIQRNEEESSSSYGLRSYVTYLDSDTLQRYATIRSKEAMSLIEKQTQALFGRPDIRILEDGKLDTSNDEVLSLSFSGLAMLVLEAVTFGSFLWDAESYVESKYHFLKA

SEQ ID NO: 4859 - protein, 421 aa, Raphanus sativus
GSLSFLKNQIESKRRKMQAIGSYGCLCFKHYHSLSKFISPTPSPSPSLLPQRCHSLCYPKLGSSSSNTENGRGRSVTVRASVEDGTSDNFAPIAPVELESPVGQLLDQILRTHPHLLPVTVDQQLDKLSTENENLKAESSSSQDVLSKRISEVKDKEKRKTLAEIIYCLVVHRFVEKGITMIPQIKPTSDPAGRIDLWPNQEEKLEVIHSAEAFEMIQSHLSSVLGDGTAVGPLSSIVQISKIKLGKLYAASVMYGYFLRRIDQRYQLERTMNTLPKRPEKNRERYEEPSPPYPLWDPDSLIRIQPEEYDPDEYAIQRNEDESSSYGLRSYVTYLDSDTLQRYATIRSKEAMSLIEKQTQALFGRPDIRILEDGKLDTSNDEVLSLSFSGLAMLVLEAVTFGSFLWDAESYVESKYHFLKA

SEQ ID NO: 4860 - protein, 481 aa, Arabidopsis lyrata
MSPSGESTNGSRCSSCISGDIYGDDFRKSDEFTCKQCKNSDSKSKSKSVNDSEKLRRIIVASVKGFTIGTGLKGGLAIFSIVARFARRRRSSLQSRKTGEFSNSEAIAMGIKETLRYGLFLGTFAGTFVSVDEAIAALAGDKRTAKWRALFAGLVAGPSMLLTGPNTQHTSLAVYILMRAAVLASRCGIKSKRFGSICKPLTWKHGDLFLMCLSSSQILSAYILKQESLPSSYKSFLNKQGGKDLSILQGVKDIASAQPFTNLRAIEKYYKSVGVDIKLDPNMKVPCSIIHGNESCVKHGITFFLQAYKRALPVYVPVYLIPALIVHRQDLLKKQYSILGKGLLGTARSSLFLATYCSSAWAWTCLLFRTFETCNIPLVAIATFPTGLALAIEKKSRRIEISLYCLARAIESFFTCMTDAGYIRPPKSLRRADVVVFSVSTAIIMHCYAQEREVFRSKYLNVLDWVFGVPPPPLPPPCETT

SEQ ID NO: 4861 - protein, 477 aa, Brassica napus
  misc_feature (17)..(17): Xaa can be any naturally occurring amino acid
MSPSRRKANGSRCSCIXGEIDGISGGESFDLTCTHCNGSDSIKPDPASSWFLSSLSETKLDDSEKLRRIIVASLKGFSIGTGIKGGLALFSIIVRFARRRSSSKSRRTGDFSNSEAISMGIKETLRYGLFLGTFAGTFVSVDEAICSLVGHQRTAKWRALFAGLVAGPSMLLTGPNTTHTSLAVYILMRAAVLASRCGIKSKRFGSICKPLTWKHGDLFLMCLSSSQILSSYILKQDSLPSSYKSFLNKQGGKDLSIIQGVKDIASAKPFTNLRAIEKYYKSVGVDIKLDPNMKVPCSIIHGKESCTKHALTFFLQAYKRALPVYVPVYLIPALIVHRQDLLKKQYSILGKGLLGTARSSLFLSTYCTSSWAWTCLLFRIFETCSIPIVAIATFPTGLALAIEKKSRRIEISLYCLARAIESFFTCMTDAGYIRPPKILRRADVVVFSVSTAIIMHCYAQEREVFRSKYLNVLDWVC

SEQ ID NO: 4862 - protein, 477 aa, Brassica napus
MSPSRRKANGSRCSCTGGEIDGISGGESFDRTCTHCNGSDSIKPDPASSWFLSSLSETKLDDSEKLRRIIVASLKGFSIGTGIKGGLALFSIIVRFARRRSSSKSRRTGDFSNSEAISMGIKETLRYGLFLGTFAGTFVSVDEAICSLVGHQRTAKWRALFAGLVAGPSMLLTGPNTTHTSLAVYILMRAAVLASRCGIKSKRFGSICKPLTWKHGDLFLMCLSSSQILSSYILKQDSLPSSYKSFLNKQGGKDLSIIQGVKDIASAKPFTNLRAIEKYYKSVGVDIKLDPNMKVPCSIIHGKESCTKHALTFFLQAYKRALPVYVPVYLIPALIVHRQDLLKKQYSILGKGLLGTARSSLFLSTYCTSSWAWTCLLFRIFETCSIPIVAIATFPTGLALAIEKKSRRIEISLYCLARAIESFFTCMTDAGYIRPPKILRRADVVVFSVSTAIIMHCYAQEREVFRSKYLNVLDWVC

SEQ ID NO: 4863 - protein, 652 aa, Arabidopsis lyrata
MAPKSKEKSKTSTSQPPLAIEDLFSSLNGHIQGSEFEEAVKVADKVLSILPTDEDAIRCKVVALIKDDKIDGALSVISSFQKLPIDLGFQNAYCLYRLNKLDEALVCLKGLERDSDTLLLESQILYRLGKADACVDVCQKLSKSEIESLEINLVAALITAGKASQVPKALEGLKIKPTSTYDLAYNTACSLIENNNYADAEQLLLTAKRIGQETLTEDDCSDEYIETELAPISVQLAYVQQVLGQTQESTSSYVDIIKRNLADEPSLAVAVNNLVASKGSKDISDGLRKFDRLKEKDSQNFQLSQELDAKLSQKNKEAIYANRVLLLLHANKMDQARELSAALPGMFPESVIPTLLQAAVLVRENKAAKAEELLGQCAEKFPEKSKLVLLARAQIAASASHPHVAAESLSKIPDIQHLPATVATIVALKERAGDNDGAAAVLDSAIKWWSNSMTESNKLSVMMPEAAAFKLRHGQEEEASRLYEEIVKNHNSTDALVGLVTTLARVNVEKAETYEKQLKPLPGLKAVDVDNLEKTSGAKPIEGAAASSSQEEVKKEKAKRKRKRKPKYPKGFDPANPGPPPDPERWLPRRERSSYRPKRKDKRAAQIRGSQGAVTKDKQEAAPSTSKSNQAASSKANAAAPSSKASKKKSRR

SEQ ID NO: 4864 - protein, 516 aa, Arabidopsis lyrata
MEEDKQMHEEKSSPVKGEEPEIEKLTVADTDAPPKSTGGWGWGFSGFSVLSDLQKAAEEISRNAAAVAEKAAKSIADMGEVDEDSESSAKEEEKTEEADTEQDSDDENAKLKKSALARLEGASEESLLSQAISRCFIFQGLKVFDDSVESFTSGAWQAFGNALKGGTSLVQKLENSVEQGSSPREAGSGAPSLLETGKALTAKGMQVLEFVGKETMDLLITETGIGAEKDRVDFKDQVLEEVTFDRCFYIYGGPEQLEELEALASHYTLLFNRKKGKLSPDQKSLYDGKLKQIQQLFSFADEMSGSKAESDKGKKIDIKTEGNDDDMKNLHNSSVSKAADMAAGFTNALAGLNVNDMIQRTGGRLESLHSEGVHRLSEMCCFAVTHLLILSKSMISHANKVQDEDTEALKIEWPEDPTEKAKLIKGKAESMTGYVEAVSNSFITGISDVSETYSAAIKGVAAADSKDDLLKTSTMQEKASTFNDSLRSDQTTAITKIQEGLQYLSYVVISTSMPSA

SEQ ID NO: 4865 - protein, 491 aa, Brassica napus
MEGDKQTHDEKKHSSEEESIRREDPPTPENTGGWGWGFSVLSDLQKAAEDLSRNAAAVAEKAAKSIADMQEADEDSESSAKEEEITDTEQDSDDESLKLKKLALGKLEDASEESLLSQGLKVFDDSVESFTSGAWLALGNALKGGTSLVQKLEDSVQQGSSPREAGSGAPSLLETGKALTAKGMQVLEFVGKETMDLLITETGLGNEKNRDQMMEEVTFDRCFYIYGGPEQLEELEALSSHYTLLFNRRKGKLSQDEKVLFDGTLKQIQQLFSFADEMSGRKAESDKGKKIDINTEGNDDDMKNLYNSSVSKAADMAAGFTNALAGLNINDTIQRTGGRLESLHSEGVHGLSEMCCFAVTHLLILGKSIISHANKVEDEDAETLKIEWPEDPTEKARLIRGKAELMAGYVEAVSNSFITGISDVSETFSAAIKGAAADDSKDELLKTSTMEEKASTFNNSLRSDQTTAITKIQEGLQYLSYVVITTSMPSA

SEQ ID NO: 4866 - protein, 527 aa, Brassica napus
  misc_feature (35)..(36): Xaa can be any naturally occurring amino acid
  misc_feature (44)..(44): Xaa can be any naturally occurring amino acid
  misc_feature (47)..(47): Xaa can be any naturally occurring amino acid
  misc_feature (49)..(49): Xaa can be any naturally occurring amino acid
  misc_feature (54)..(56): Xaa can be any naturally occurring amino acid
  misc_feature (65)..(65): Xaa can be any naturally occurring amino acid
  misc_feature (74)..(74): Xaa can be any naturally occurring amino acid
  misc_feature (77)..(77): Xaa can be any naturally occurring amino acid
  misc_feature (82)..(82): Xaa can be any naturally occurring amino acid
  misc_feature (88)..(88): Xaa can be any naturally occurring amino acid
  misc_feature (94)..(94): Xaa can be any naturally occurring amino acid
  misc_feature (105)..(105): Xaa can be any naturally occurring amino acid
  misc_feature (107)..(107): Xaa can be any naturally occurring amino acid
  misc_feature (120)..(120): Xaa can be any naturally occurring amino acid
  misc_feature (132)..(132): Xaa can be any naturally occurring amino acid
  misc_feature (140)..(140): Xaa can be any naturally occurring amino acid
  misc_feature (316)..(316): Xaa can be any naturally occurring amino acid
ELKYSFDSNPFVTIFIQFASETLIRSRNRQRRWRXXTNNRTRGXKNXFXERMPXXXNRRRRTPAXGDGGFPASXCSXIFKKXPKIYLXMLQQWXRKQRKALRICXKXMKTQNLLPRKKRXLMTEQDSDDESXKLKKLALXKLEDASEESLLSQGLKVFDDSVESFTSGAWMALGNALKGGTSLMQKLEDSVQQGSSPREAGSGAPSLLETGKALTAKGMQVLEFVGKETMDLLITETGLGNEKNRDQMMEEVTFDRCFYIYGGPEQLEELEALSSHYTLLFNRRKGKLSQDEKVLFDGKLKQIQQLFSFADEMSGXKAESDKGKKIDTKTEGSDDDMKNLHNSSVSKAADMAAGFTNALTGLSVNDIIQRTGGRLESLHSEGVHRLSEMCCFAVTHLLTLGKSMISHANKVQGEDTEALKIEWPEDPTEKAKLIRGKAESMAGFVEAVSNSFITGISDVSETYSAAIKGASTDDDSKDNLLKTSTMEEKANTFNDSLRSDQTTAITKIQEGLQYLSFVVISTSMPSA

SEQ ID NO: 4867 - protein, 501 aa, Brassica napus
MEDDDEQSHEGAKEPIPREDAETAESPPKNTGGWGWGFSGFSVLSDLQKAAQDISRNAAAVAEKAAKSIADMQEGDEESESESSAKGEEKAEEPEDSDDESHKLKKLALAKLEDASEESLLSQGLKVFDDSVESFASGACLALGNALKGGTSLVQKLENSVQQGSSPREAGSDAPSLLETGKALTAKGMQVLEFVGKETMDLLITETGLGVDKNEEGFKDQTIEEVTFDRCFYIYGGPEQLEELEALSSHYTLLFNRRKGKLSQDEKSMYDGKLKQIQQLFSFAAEMSGIKAESDKGKQIDTKAEGSDDDMKNLHNSSVSKAADMAAGFTNALTGLSVNDIIQRTGGRLESLHSEGVHRLSEMCCFAVTHLLTLGKSMISHANKVQDEDTEALKIEWPEDPTEKAKLIRGKAESMAGFVEAVSNSFITGISDVSETYSAAIKGASTDDDSKDNLLKTSTMEEKANTFNDSLRSDQTTAITKIQEGLQYLSFVVISTSMPSA

SEQ ID NO: 4868 - protein, 317 aa, Arabidopsis lyrata
MAGGGNRRDEGSITIQSTNLFAALDTRKKKKKSGKSKGSSKSREPEKEPEPQVFWAPTPLKVKSWADIDDDDDDDDYYATTAPPQSGWSTSVPSHSDSKDVHVEESESEEDILDEGDDDVEEEQEQETEVQVHPEPEPEVKKAPEVPGPPKEAERQLSKKERKKKELAELEALLADFGVAPKENNGQDESQEAKQEKKEDVNGEGEKKENAAGGESKASKKKKKKDKQKEVKESQEQQANNNADAVDEAAGSEPTEEETPIDVKERLKKLASMKKKKSGKEVDAAAKAAAEEAAARRKKLAAAKKKEKNHYNQQPVR

SEQ ID NO: 4869 - protein, 310 aa, Raphanus sativus
MAGGGGNRRDEGSITIQSTNLFAALDTRKKKKKNSGKSKEGSSSKSKAPHKEPEPQVFWAPTPLKVKSWADIDDDDEDDDYYATTAPPTSGWATSEPKDTHVEESESEEDILDEGDDDVDEEQEHETEVQVHPEPEPEVKKAPEVPAPPKEAERQLSKKERKKKELAELEALLADFGVAPKEDNGQDASKEAKEETNGEGEKKENAAGGESKASKKKKKKDKQKEVKESQEQQANADAVGEAAGSEPAEEDSAIDVKERLKKIASMKKKKSSKEVDAGAKTAAQEAAARRAKLAAAKKKEKNHYNQQPVR

SEQ ID NO: 4870 - protein, 302 aa, Brassica napus
MAGGGNRREEGSITIQSTNLFAALDTRKKKKKTDKAGKSKGSSSSSSKTQKEPEPQVFWAPTPLKVKSWADIDDDDEDDDYYSTTAPPLPSGWTTSEPKDTPVEESESEEDVLDEGDDDVDEEHETEVLVHPEPEPEVKKAPEAPAPPKEAERQLSKKERKKKELAELEALLADFGVAPKEDNGQQEAKEEIKGEGEKENAAGGESKASKKKKKKDKQKEVKESQEQQANADEAAGSEPTEEESAIDVKERLKKIASMKKKKSSKEMDAGAKTAAQEAAARRAKLAAAKKKEKNHYNQQPVR

SEQ ID NO: 4871 - protein, 304 aa, Brassica rapa
MAGGGNRREEGSITIQSTNLFAALDTRKKKKKTDKAGKSKGSSSSSSSKTQKEPEPQVFWAPTPLKVKSWADIDDDDEDDDYYATTAPPLPSGWTTSEPKDTPVEESESEEDVLDEGDDDVDEEHETEVQVHPEPEPEVKKAPEAPAPPKEAERQLSKKERKRKELAELEALLADFGVAPKEDNGQEEAKEEINGEGEKKENAAGGESKASKKKKKKDKQKEVKESQEQQANADEAAGSEPTEEESAVDVKERLKKIASMKKKKSSKEMDAGAKTAAQEAAARRAKLAAAKKKEKNHYNQQPVR

SEQ ID NO: 4872 - protein, 799 aa, Arabidopsis lyrata
MRWDLIAAIVAALVVSGLADESGQRAPYRIHTLFSVECQNYFDWQTVGLMHSFLKSGQPGPITRLLSCTDDQKKNYRGMNLAPTFEVPSWSRHPKTGDWYPAINKPVGVLYWLQHSEDAKHVDWVVILDADMIIRGPIIPWQLGAERGRPFAAHYGYLVGCDNILVRLHTKHPELCDKVGGLLAMHIDDLRVLAPLWLSKTEDVRQDTAHWSTNITGDVYGKGWISEMYGYSFGAAEAGLKHKINDDLMIYPGYVPREGVEPILMHYGLPFSIGNWSFTKLDHHEDNIVYDCNRLFPEPPYPREVKIMEPDPYKRRGLILSLECMNTLNEGLILRHAENGCPKPKWTKYLSFLKSKTFMELTKPKLLVPGSVHILPDQHEPPPINEFKGTYPKIHTLFSTECTTYFDWQTVGFMHSFRQSGQPGNITRLLSCTDEALKNYKGHDLAPTHYVPSMSRHPLTGDWYPAINKPAAVVHWLHHTNIDAEYVVILDADMILRGPITPWEFQAARGRPVSTPYDYLIGCDNDLARLHTRNPEACDKVGGVIIMHIEDLRKFAMYWLLKTQEVRAEKEHYGKELTGDIYESGWISEMYGYSFGAAELNLRHIINKEILIYPGYVPEPGADYRVFHYGLEFKVGNWSFDKANWRNTDLINKCWAKFPDPPSPSAVHQTDNDLRQRDLLSIECGQKLNEALFLHHKRRNCPEPGSESTEKMSVSRKVGNIETKQTQGSDDTKESSGAEGRFSTLKLWVIALWLISGVGFLVVMLLVFSTRRGRGTTRGKGYRNKRRTSYSNTGFMDTK

SEQ ID NO: 4873 - protein, 805 aa, Brassica napus
MLWGLMLVIAALAVAFGSGSADEWGQRAPYRIHTLFSVECQNYFDWQTVGLMHSFKKSRQPGPITRLLSCTEEEMKNYRGMDLAPTFRVPSWSRHPKTGDWYPAINKPVGVLHWLQHSEDAKNVDWVVILDADQIIRGPIIPWELGAERGRPFAAHYGYLVGCDNMLVRLHTNHPELCDKVGGLLAMHIDDLRVLAPLWLSKTEDVRQDTAHWSTNLTGDVYGKGWISEMYGYSFGAAEAGLKHKINDDLMIYPGYVPREGVEPILMHYGLPFSIGNWSFTKLDHHEDNIVYDCNRLFPEPPYPREVKMMEPDQYKRRGLLLSLECMNTLNEGLIMRHAENGCPKPKWSKYLSFLKSKTFMELTKPKLLAPGSVHILPDQHQHQQPPPVDEFKGPYPKIHTLFSTECTTYFDWQTVGFMHSFRLSGQPGNITRLLSCTDEDLKKYKGRDLAPTHNVPSMSRHPLTGDWYPAINKPAAVVHWLHHTNIDAEYIVILDADMILRGPITPWEYKAARGRPVSTPYDYLIGCDNDLAKLHTRNPEACDKVGGVIIMHIDDLRKFAMYWLLKTQEVRADKEHYAKELTGDIYESGWISEMYGYSFGAAELNLRHIINKEILIYPGYVPEPGVDYRVFHYGLEFKVGNWSFDKANWRNTDMINKCWSKFPDPPTPSEVHETDNDLRQRDLLSIECGQKLNEALLLHHKRRNCPEPGSESESKEESISLGSRKVGKLETKQAKGSDETTEETTSEGRFSRLKMWVIAVWVISGVGFVVVMLLVCSTRKVRARGKGYRNKRRTTSSYSKPGFE

SEQ ID NO: 4874 - protein, 805 aa, Brassica napus
  misc_feature (72)..(72): Xaa can be any naturally occurring amino acid
  misc_feature (77)..(77): Xaa can be any naturally occurring amino acid
  misc_feature (526)..(526): Xaa can be any naturally occurring amino acid
  misc_feature (578)..(578): Xaa can be any naturally occurring amino acid
MLWGLMLVIAALAVAFGSGSADEWGQRAPYRIHTLFSVECQNYFDWQTVGLMHSFKKSRQPGPITRLLSCTXEEMKXYRGMDLAPTFRVPSWSRHPKTGDWYPAINKPVGVLHWLQHSEDAKNVDWVVILDADQIIRGPIIPWELGAERGRPFAAHYGYLVGCDNMLVRLHTNHPELCDKVGGLLAMHIDDLRVLAPLWLSKTEDVRQDTAHWSTNLTGDVYGKGWISEMYGYSFGAAEAGLKHKINDDLMIYPGYVPREGVEPILMHYGLPFSIGNWSFTKLDHHEDNIVYDCNRLFPEPPYPREVKMMEPDQYKRRGLLLSLECMNTLNEGLIMRHAENGCPKPKWSKYLSFLKSKTFMELTKPKLLAPGSVHILPDQHQHQQPPPVDEFKGPYPKIHTLFSTECTTYFDWQTVGFMHSFRLSGQPGNITRLLSCTDEDLKKYKGRDLAPTHNVPSMSRHPLTGDWYPAINKPAAVVHWLHHTNIDAEYIVILDADMILRGPITPWEYKAARGRPVSTPYDYLXGCDNDLAKLHTRNPEACDKVGGVIIMHIDDLRKFAMYWLLKTQEVRADKEHXAKELTGDIYESGWISEMYGYSFGAAELNLRHIINKEILIYPGYVPEPGVDYRVFHYGLEFKVGNWSFDKANWRNTDMINKCWSKFPDPPTPSEVHETDNDLRQRDLLSIECGQKLNEALLLHHKRRNCPEPGSESESKEESISLGSRKVGKLETKQAKGSDETTEETTSEGRFSRLKMWVIAVWVISGVGFVVVMLLVCSTRKVRARGKGYRNKRRTTSSYSKPGFE

SEQ ID NO: 4875 - protein, 359 aa, Arabidopsis lyrata
MQLFHSCCGKGFDGKKKEKEEPSWRVFSLKELHAATNSFNYDNKLGEGRFGSVYWGQLWDGSQIAVKRLKAWSNREEIDFAVEVEILARIRHKNLLSVRGYCAEGQERLLVYEYMPNLSLVSHLHGQHSAECLLDWTKRMKIAISSAQAIAYLHDHATPHIVHGDVRASNVLLDSEFEARVTDFGYGKLMPDDTGDGATRAKSNNGYISPEYVTSGKESETSDVYSFGILLLVLVSGKRPLERLNPTTTRGITEWVLPLVYERKFGEIVDKRLSEEHVEEKLKKVVLVGLMCAQTDPDKRPTMSEVVEMLVNESKEKMSELEANPLFKNPYSNNENNREHVTEVSSDVISEEKDQQQHE

SEQ ID NO: 4876 - protein, 205 aa, Arabidopsis lyrata
MSSVCGGLDFKDAESSSASSPNICSNGSSKHISCVGSDDAQESDGDDSGYIQQYVIEDSKDKAICEPILESLPLESLDDETEDKNLASALQDMFSESMSVVTLIPAIKGGREKHGKSLEKLRVSWAEDVYDPPPSIVSHTRSKKQQPQKSKSKDNLKKNGKKGQKGSSHSRGSKDKKQISSRSSSKYSRDKFDWATQMSVLAASS

SEQ ID NO: 4877 - protein, 407 aa, Arabidopsis lyrata
MSLICRLNLCRRFSTALPRRAEDIMSNPDCRPAQLCLRVSYLIRFVGDLDTAAKYARLAVFTDIKSEATAATCQAIIGGMLQNKRHDDAYDLYDFFFNHFKLRPNSHCCNYIIESRFKQGLVDEALGFHHRSIESGMVHDYPSNDTFRVLTKGLVHSGRLDQAEAMLRDRTVDRIIYPDHVAYNYLIRGFLDLGNLGKANLVLDEFKRLFLITLSETKDDLHHSNYENRVAFVMATFMEYWFKQGKEVEAMECYNRSVLSNRLLVCAETANALLVVLLKYGEKKHAWALYHDILDKSRTYPDTIKIMVDECFDMGRFREAMKTYNKARAKNHYLSDIYIFTKCCQNGMLSEAESIFADSLADDFAYIDVDTSKTMMDSYVKAGRIHDAIKTSNKMIDATLQEVSHLF

SEQ ID NO: 4878 - protein, 307 aa, Arabidopsis lyrata
MADSTKVRLVRCPKCENLLSEPEDSPFFQCGGCFTVLRAKIKEREADSVSVKSVEDKAKPISANSTSSPEKAIVDSSETSSDSDVPSNSVSLRHHQNVVPVDVESDPGSKEQGNRSILGDKDDLKSQSGRQDSGLDRFRKRTTTRCDSESVINRLSTSRHPCDEGTSSSANYFPDSLHEFQKHLKDQSNEAIEQDRAGLLRQLEKIKEQLVQSCNVATDKSKEQVPSSSSASGLNKAPPMRFHSTGNHAVGGPSYYHQHPEPQFPYNNNNNEVPMHHSLMHPSYGDTHRFPIHGRGPHPLLLGTICW

SEQ ID NO: 4879 - protein, 355 aa, Arabidopsis lyrata
MEWIKSMPKIELHAHLNGSIRDSTLLELARVLGEKGVIVFADVEHVIRKNDRSLVEVFKLFDLIHKLTTDHKTVTRITREVVEDFALENVVYLELRTTPKRNDSIGMSKRSYMDAVIEGLRSVSEVDIDFVTASDSQKLLNACDGIGRKKIYVRLLLSIDRRETTESAMETVKLALEMRDVGVVGIDLSGNPLVGEWSTFLPALQFAKDSNLHITLHCGEVPNPKEIQAMLDFKPHRIGHACFFKDEDWTKLKSFRTPVEICLTSNIITKSISSIDIHHFADLYNANHPLILCTDDFGVFSTSLSNEYALAVRSFGLSKRETFALARTAIDATFAEDEVKQQLWLIFDSASPEYA

SEQ ID NO: 4880 - protein, 355 aa, Brassica napus
MEWIHPMPKIELHAHLNGSIRDTTLLELARVLGEKGVIVFSDVEDVIQKNDRSLDEVFKLFDLIHMITTDHQTVTRITREVVQDFALENVVYLELRTTPKRNDSIGMSKRSYMEAVIKGLRSISEVDVEFVAAPDSEKLHNSCDGVGRKKIYVRLLLSIDRRETTESAMETVKLALEMRNVGVVGIDLSGNPLVGEWSTFLPALQFAKDNDLYITLHCGEVPNPKEIQAMLDFKPHRVGHACFFKDQDWEKLKSFRIPVEICLSSNIITKSISSIDIHHFADLYKAKHPLIICTDDFGVFSTTLSNEYSLAVRSFGLGKRETFALAKSGIDATFAEDEVKQQLGLIFDSASPEYV

SEQ ID NO: 4881 - protein, 349 aa, Raphanus sativus
MEWIHTMPKIELHAHLNGSIRDSTLLELARVLREKGVTELTDVEDVIQKNDRSLDEVFKLFDLIHVITTDHQTVTRITREVVQDFALENVVYLELRTTPKRNDSIGMSKRSYMEAVIKGLRSISEVDVEFFNSQQLNKSCGRKKIYVRLLLSIDRRETTESAMETVKLALEMRNVGVVGIDLSGNPLVGEWSTFLPALQFAKDNDLYITLHCGEVPNPEEIQAMLDFKPHRVGHACFFKDQDWEKLKSFRIPVEICLSSNIITKSISSIDVHHFADLYKVKHPLIICTDDFGVFSTTLCNEYSLAVRSFGLGKRETFSLAKSGIDATFAEDEVKQQLRLIFDSASPEYV

SEQ ID NO: 4882 - protein, 1146 aa, Arabidopsis lyrata
MIPNGELRLPAPKVRDGRVSPPAPIPVTRTLVADTDATSDDDDMSTNSEDVSLDSSPENSRVSSAVGRSYGRNSSYYTYSEVSSSRETLVGAREQTGPRFDGDTEEDESTDSASSSQFSPPPAAGRINGGVPQEFDETFPSEEVSDIPSAPPFSGAAEESEEIKPATSSVQVSEVKTEDCVESRKTGHFTRPSAASESSGAPDQHPARLPTFHASSRGPWHAVVSYDACVRLCLHAWSTGCMEAPMFLENECALLREAFGLQQLLLQSEEELLAKRSSQAPHEGVAPKSKKNIGKMKVQVRRVKTVMDGPTGCSISSLKPSLIKFEKIRIHFSNMSTRLFSGWRALRKIHVRVPANGSSLPRQSLAYVHASTQYLKQVSGLLKTGVTSLRNNSTSYDVVQETYSCKLKLKSLAEDDAIMMQPGSGESHVFFPDSHGDDLIVEILDPMGKDFGRVLVQLANISEDSYVSNDSNEETIQAEKLRWWSVFREPEHQHVGKLQLYIDYSASFDDNSHLKCASVAETVAYDLVLEVALKMQRFQQRNLLLYGSWKWLLEEFATYYGISDVYTKLRYLSYVMDVATPTSDCLHLVHDLLTPVIMKGNGKSALSHQENRILNEIKDQIEQILKLVFENYKSLDESSFSGMIDVVSSASGVPAPALTPAVKLYTLLHDVLSPEDQTNLCHYFQAAAKKRSRRHMGETDEFVANNSEPNFWDTSAMSAAYQKMTMACKNVKNEIYTDIEIQNEDILPSFLDLPNLSASIYSTDLCNRLRAFLVACPPSGPSPTVAELVIATADFQRDLSSWNISPIQGGVDAKELFHLYIMIWIQDKRLSLLESCKLDKVKWSGVRTQHSTTPFVDEMYKRLNETIQDYQVIISRWPEYIFVLESAIADVEKATVEALEKQYADVLSPLKENLAPKKLSFKYVQKLTKRSVIPYIVPDELGILLNSMKRMLDVLRPNIEAKFKAWSSCIPDGGNAAPGDRLSEVTVMLRAKFRSYLQAVVEKLVENSKLQKTTMLKKILQDSKESVGESDIRSKMNNLKEQLTNTVNHLHSVCETHVFIALSRGYWDRMGQIVLSFLENRKENRAWYKGSRVAVSILDDTFAAQMQQLLGNSLREQDLEPPRSIMEVRSILCKDTADNKAKSFYY

SEQ ID NO: 4883 - protein, 441 aa, Arabidopsis lyrata
MYRISATSNLVPFLPSSSFVPTRRCYPRRATPYSRRINLKPLTSRIVLLTRRRQLGQIVEEVEAAKKRYGKLNTIVMNSVLEACVHCGNIDLALRMFHEMAEPGGIGVDSISYATILKGLGKARRIDEAFQMLETIEHGTVAGNPKLSSSLIYGLLDALINAGDLRRANGLLARYDILLLDHGTPSVLIYNLLMKGYVNSESPQAAINLLDEMLRLRLEPDRLTYNTLIHACIKCGDMDVAMKFFKEMKEKAEEYYDDFLQPDVVTYTTLVKGFGDAKDLLSLQDIYLEMKLCDNVFIDRTAFTAVVDAMLKCGSTSGALCVFGEILKRSGANEVLRPKPHLYLSMMRAFAVQGDYGMVRNLYLRLWPDSSGSISKAVQQEADNLLMEAALNAGQLDEALGILSSIVRRWKAIPWTTSGGMAAVRLEALLGFSNLYCVHIY

SEQ ID NO: 4884 - protein, 185 aa, Arabidopsis lyrata
MATRRALINVHRIIRSTAVVGRRSVIPAAANRIIFRNGVDSGTRFFCGNTASAQNFDIDLSNEENKRRTINRLLYRSKQRGFLELDLVLGNWVEENVDSMDENGVKSLIHVLNLENPDLWKWLTEQEQPPEEVSSNPVFSALHEKVMKNLNKHAAPETRAAAGQPWVKGWDDFKRGRDAPISGNQ

SEQ ID NO: 4885 - protein, 187 aa, Brassica napus
MASRKALINIHRIIRSTAVVNRRSVIPAAAARSHPIFRNGVDFAPRFFCGNTSSPQNFDIDLSSEEKKRITINRLLYRSKQRGFLELDLVLGNWVEENVNSMDENTVKSLIHVLDLENPDLWKWLTGQEQPPEIVSSNPVFLALHKKVMTNLNKHAAPETRAEAGQPWVKGWDDFKRGRDAPISGNQ

SEQ ID NO: 4886 - protein, 184 aa, Brassica napus
MASRKALINVHRIIRSTAVVRRSSVTPSAAPPIFQNGVDLGARFFSGNTSSPQNIDIDLSSEEKKRITINRLLYRSKQRGFLELDLVLGNWVEENVNSMDETAVKSLIHVLDLENPDLWKWLTSQEQPPEIVSSNPVFLALHKKVMTNLNKHAAPETRAAAGQPWVKGWDDFKRGRDAPISGNQ

SEQ ID NO: 4887 - protein, 187 aa, Raphanus sativus
  misc_feature (3)..(3): Xaa can be any naturally occurring amino acid
MAXRKALINIHRIIRSAAVVNRRSVIPAAATQSHPIFRNGVGLGARFLCGDTSSPQNFDIDLSSEEKKRITINRLLYRSKQRGFLELDLVLGNWVEENVNSMDENTVKSLIHVLDLENPDLWKWLTGQEQPPEIVSSNPVFLALHNKVMTNLNKHAAPETRAEAGQPWVKGWDDFKRGRDAPISGNQ

SEQ ID NO: 4888 - protein, 187 aa, Thellungiella halophila
  misc_feature (2)..(2): Xaa can be any naturally occurring amino acid
  misc_feature (28)..(29): Xaa can be any naturally occurring amino acid
MXSRKALINVHRIIRSTAVTSRNSVTPXXATRTHPIFRNRVDLGMRFFSGNTASPQNFHIDLSNEENKRITINRLLYRSKQRGFLELDLVLGNWVEENVNSMDENAVKSLIDVLGLENLDLWKWLTGQEQPPEAVSSNPVFMALHEKVMKNLNKHAAPETRAAAGEPWVRGWDDFKKGRDAPISGNQ

SEQ ID NO: 4889 - protein, 181 aa, Brassica juncea
MASRKALINVHRIIRSTAVVRQSSVTPSAAPPIFQNGVDLGARFFCSSPQSFDIDLSNEEKKRITINRLLYRSKQRGFLELDLVLGNWVEENVNSMDETAVKSLIHVLDLENPDLWKWLTAQEQPPEIVSSNPVFLALHKKVMTNLNKHAAPETRAAAGQPWVKGWDDFKRGRDAPISGNQ

SEQ ID NO: 4890 - protein, 181 aa, Brassica napus
MASRKALINVHRIIRSTAVVRRCSVTPSAAPPIFQNGVDLGARFFCSSPQSFDIDLSNEEKKRITINRLLYRSKQRGFLELDLVLGNWVEENVNSMDETAVKSLIHVLDLENPDLWKWLTAQEQPPEIVSSNPVFLALHKKVMTNLNKHAAPETRAAAGQPWVKGWDDFKRGRDAPISGNQ

SEQ ID NO: 4891 - protein, 187 aa, Raphanus sativus
MASRKSLINVHRIIRSTAMVSRRSVTPAAATRAHPIFRNRVDLGARFFSGNTPSPQNFDIDLSNEEKKRITVNRLLYRSKQRGFLELDLVLGNWVEENVDSMDETTVKSLIHVLDLENPDLWKWLTAQEQPPEIVSSNPVFLALHKKVMTNLNKHAAPETRAAAGQPWVKGWDDFKRGRDAPISGNQ

SEQ ID NO: 4892 - protein, 182 aa, Brassica rapa
ALTNIHRIIRSTAVVNRRSVIPAAAARSHPIFRNGVDFAPRFFCGNTSSAQNFDIDLSSEEKKRITINRLLYRSKQRGFLELDLVLGNWVEENVNSMDENTVKSLIHVLDLENPDLWKWLTGQEQPPEIVSSNPVFLALHKKVMTNLNKHAAPETRAEAGQPWVKGWDDFKRGRDAPISGNQ

SEQ ID NO: 4893 - protein, 187 aa, Raphanus sativus
MASRKSLINVRRIIRSTAVVSRRSVTPATATRAHPIFRNRVDLGARFFSGNTTSPQNFEIDLSNEEKKRITINRLLYRSKQRGFLELDLVLGNWVEENVDSMDETTVKSLIHVLDLENPDLWKWLTAQEQPPEIVSSNPVFLALHKKVMTNLNKHAAPETRAAAGQPWVKGWDDFKRGRDAPISGNQ

SEQ ID NO: 4894 - protein, 187 aa, Raphanus sativus
MASRKSLINVHRIIRSTAMFSRRSATPAAATRAHPIFRNRVDLGARFFSGNTPSPQNFEIDLSNEEKKRITINRLLYRSKQRGFLELDLVLGNWVEENVDSMDETTVKSLIHVLDLENPDLWKWLTAQEQPPEIVSSNPVFLALHKKVMTNLNKHAAPETRAAAGQPWVKGWDDFKRGRDAPISGNQ

SEQ ID NO: 4895 - protein, 187 aa, Raphanus sativus
MASRKSLINVHRIIRSTAVISRRSVTPAAATRAHPVFRNRVDLGARFFSGNTTSPQNFEIDLSNEEKKRITINRLLYRSKQRGFLELDLVLGNWVEENVDSMDETTVKSLIHVLDLENPDLWKWLTAQEQPPEIVSSNPVFLALHKKVMTNLNKHAAPETRAEAGQPWVKGWDDFKRGRDAPISGNQ

SEQ ID NO: 4896 - protein, 328 aa, Arabidopsis lyrata
MNRARSYISLGLLKKSSYVSSHIPWNRCFYMPSKYSLKPSCVTALGLSSVHCYSTRSKTAKSKISTAVSVSDSDKEKDAFFVVRKGDIIGIYKDLIDCQAQVGSSVYDLPVSVYKGKGYSLLKDTTEEYLSSVGLKKPLYVFRAFDLKEDMFGPLTPCIFQDQLPSASMSVVNPLEKLAKQKPSADTSYETCIIEFDGASKGNPGLSGAAAVLKTEDGSLICKMRQGLGIATNNAAEYHGLILGLKHAIEKGYTKIKVKTDSKLVCMQMKGQWKVNHEVLSKLHKEAKQLSDQCLSFEISQVLRNLNSDADEQANMASRLSEGEVEVA

SEQ ID NO: 4897 - protein, 206 aa, Raphanus sativus
  misc_feature (193)..(193): Xaa can be any naturally occurring amino acid
  misc_feature (197)..(197): Xaa can be any naturally occurring amino acid
  misc_feature (202)..(203): Xaa can be any naturally occurring amino acid
MESSTSSAIVLHQSSNHDELFMQQTLQFSQTLKDLKNLRKQLYSAAEYFETSYGKEEHKETVIETLKEYAAKAVVNTVDHLGSVSDKFNSFLSDNSAHFSTTRLRLSSLEQRMKLCREYMGKSGTSQHCFLIQSPHHHKRYFFPQHGRGSSLAAGDDSHRFKSAVRSTILENHSNTASKTNKTGSFSFLHNNXSNIXPRVKXXNLL

SEQ ID NO: 4898 - protein, 287 aa, Brassica rapa
  misc_feature (36)..(36): Xaa can be any naturally occurring amino acid
METSTSLAIVLHQSSNHDELSMQQTLQFSQTLKDLXNLRKQLYSAAEYFETSYGKEEHKETVIETLKEYAAKAVVNTVDHLGSVSDKFNSFLSDDSAHFSTTHLRLSSLEQRMKLCREYMGKSGTSQHCFLIQSPPHHHKRYFFPQHGRGERGRGTSFSAGDDSHRFKNAVRSTILENHPITTTRKAYKTGSFSFLHNNNISNNRTPNSKRGNSPMRFPLLRSGSQLKHSSSPGQPRILALLPEPERAISLSTSREIVEIKQKSSLRKGKKSLMLKALMSMSSKSRN

SEQ ID NO: 4899 - protein, 286 aa, Raphanus sativus
  misc_feature (70)..(70): Xaa can be any naturally occurring amino acid
MESSTSLAIVLHQSANHDELFMQQTLQFSQTLKDLKNLRKQLYSAAEYFETSYGKEEHKETVIETLKEYXAKAVVNTVDHLGSVSDKFNSFLSDNSAHFSTTHLRLSSLEQRMKLCREYMGKSGTSHHCFLIQSPPHHHKRYFFPQHGRGERGRGTSFSAGDDSHRFKSAVRSTILEKHTSTTARKAYKTGSFSFLHNNMSNNRTPNSKRGNSPLRFPLLRSGSQLKHSSSPGQPRILALLPEPERAISLSTSREIVEIKQKSSLRKGKKSLMLKALMSMSSKSRN

SEQ ID NO: 4900 - protein, 287 aa, Brassica oleracea
  misc_feature (104)..(104): Xaa can be any naturally occurring amino acid
  misc_feature (130)..(130): Xaa can be any naturally occurring amino acid
MESSTSLAIVLHQSSNHDELFMQQTLQFSQTLKDLKNLRKQLYSAAEYFETSYGKEEHKETVIETLKEYAAKAVVNTVDHLGSVSDKFNSFLSDDSAHFSTTHXRLSSLEQRMKLCREYMGKSGTSQHFXLIQSPPRHHKRYFFPQHGRGERGRGTSFSAGDDSHRFKNAVRSTILENHPITTARKAYKTGSFSFLHNNNISNNRTPNSERGNSPKRFPLLRSGSQLKHSSSPGQPRILALLPEPERAISLSTSREIVEIKQKSSLRKGKKSLMLKALMSMSSKSRN

SEQ ID NO: 4901 - protein, 277 aa, Arabidopsis lyrata
MASSTSLAIVLHQSSNHDELFMKQTLQFSETLKDLKNLRKQLYSAAEYFETSYGKEEHKETVIETLKEYAAKAVVNTVDHLGSVSDKFNSFLSDNSTHFSTTHLRVSSLEQRMRLCRDYMGKSGTHQHLLLFQYPRHHKRYFFPQQGRGTSFSAGDDSHRFKSAVRTTILENLPNTARNVNKTGSFSFAPIIHNNINNRTPNKRTNSPMRFPLLRSGSLLKRSSSPSQPKKPPLPEPQRAISVSRNTEIVEIKQSSSRKGKKILMLKALMSMSKSRN

SEQ ID NO: 4902 - protein, 279 aa, Arabidopsis thaliana
MASSTSLAIVLHQSSNHDELFMKQTLQFSETLKDLKNLRKQLYSAAEYFETSYGKAEHKETVIETLKEYAAKAVVNTVDHLGSVSDKFNSFLSDNSTHFSTTHLRLSSLEQRMRLCRDYMGKSGTHQHLLLFQYPRHHKRYFFPQQGRGTSFSAGDDSHRFTSAVRSTILENLPNTARKANKTGSFSFAPIVHNNINNRTPNKRSNSPMRFPLLRSGSLLKRSSSPSQPKKPPLALPEPQRAISVSRNTEIVEIKQSSSRKGKKILMFKALMSMSKSRN

SEQ ID NO: 4903 - protein, 357 aa, Glycine max
MGKTSWLIILVTCLCLLAFSDGRELKVRHKKPHYQYNHTLATILVEYASAVYLSDLTELFTWTCSRCNGLTKGFEMIELVVDVEHCLQAFVGVADDPCAIIIAFRGTNEHSLQNWIEDLYWKQHDINYPGMDDAMVHRGFYTAYHNTTIRPAILDAVERAKKFYGDIEIIATGHSMGGAMASFCGLDLTVNQNEKNVQVMTFGQPRVGNAAFASLYTKLVPNTIRVTNDHDIVPHLPPYYYYLPQKTYHHFPREVWLYNIGLGSLVYNVEKICDESGEDPDCSRSVTGNSIADHLVYYGVDMGSDEPSSCRIVMDSHVQNTSIRDSRGNLILSRDPATPLIKLGGEGDNQENPINVD

SEQ ID NO: 4904 - protein, 356 aa, Cajanus cajan
MGKSRWLILVICLCLLAFSDGRELHVRHKKNHYQYNHTLATILVQYASAVYLSDLTELFTWTCSRCDGLTKGFDIIELVVDVEHCLQAFVGVADDPHAIIIAFRGTNEHSLQNWIEDLYWKQHEINYPGMDDAMVHRGFYMAYHNTTIRPAVLDAVERAKKFYGDIQIISIGHSMGGAMASFCGLDLTVNQNEKNVQVMTFGQPRVGNAAFASLYSKLVPNTIRVTNDHDIVPHLPPYYYYLPQKTYHHFPREVWLYNIGLGSLVYSVEKICDGSGEDPTCSRSVSGNSIVDHLAYYGVDMGSDEPSSCRIVMDSHVQKTSIKDSRGNLILSRDPATPIIKLSREIDNQENPVNVD

SEQ ID NO: 4905 - protein, 357 aa, Glycine max
MGKTRWLIILVTCLCLLSFSDGRELKVRHKKQHYQYNHTLATILVEYASAVYLSDLTELFTWTCSRCNGLTKGFEMIELVVDVEHCLQAFVGVADDPHAIIIAFRGTNEHSLQNWIEDLYWKQHDINYPGMDDAMVHRGFYTAYHNTTIRPAILDAVERAKKFYGDIEIIATGHSMGGAMASFCGLDLTVNQNEKNVQVMTFGQPRIGNAAFASLYTKLVPNTIRVTNDHDIVPHLPPYYYYLPQKTYRHFPREVWLYNIGLGSLVYSVEKICDESGEDPNCSRSVTGNSIADHLVYYGVDMGSDEPSSCRIVMDSYVQNTNIKDSRGNLILSRDPATPLIKLSGEGDNQENPINVD

SEQ ID NO: 4906 - protein, 356 aa, Arachis hypogaea
MKKTWWLILVTFLCLLSSSNGRDLKARDKVNLPKYNHTLATILVQYASAVYLSDLTALFTWTCSRCDGLTEGFEIIELVVDVEHCLQAFVGVADDPHAIIIAFRGTNEHSLQNWIEDLYWKQHEINYPGMDDAMVHRGFYNAYHNTTIRPAILDAVDRAKKFYGNIQIIVLGHSMGGAMAAFCGLDLTVNRCEKNVQVMTFGQPRIGNAVFASLYSTLVPNTLRVTHDHDIVPHLPPYYYYLPSKTYHHFPREVWLYNVGLGSLVYRVEKVCDGSGEDPTCSRSVSGNSISDHLVYYGVEMGSDAPDSCRIVMGSNDSSPSVQDSRGNIVLTREPAKFVLKLSRELDNQGKAISVS

SEQ ID NO: 4907 - protein, 356 aa, Phaseolus coccineus
  misc_feature (273)..(273): Xaa can be any naturally occurring amino acid
MGKTTWLILVTFLCLFAFSNGRGLKVRQKNHPYKYNHTLATTLVEYASAVYLSDLTELFTWTCARCDDLTKGFDMIELVVDVEHCLQAFVGVAEDPHAIIIAFRGTNEHSLQNWIEDLYWKQHDINYPGMDDAMVHRGFYTAYHNTTIRPAILDAIDRAKKFYGDIQIIATGHSMGGAMASFCGLDLTVNKNEKNVQVMTFGQPRVGNAVFASLYSELVPCTVRVTNDHDIVPHLPPYYYYLPQKTYHHFPREVWLYNIGLGSLVYSVEKICXESGEDPDCSRSVTGNSIADHLVYYGVDMGSDEPSSCRIVMDPYLQSASIKDSRGNIILSKDPATPLIKLSRESGNQKNPINVD

SEQ ID NO: 4908 - protein, 578 aa, Lotus japonicus
MACLALRPMHEEAFGDFTSCFSHHLRDSILIYLTVGGSVVPMHIMETDSIASMKLRIQTFKGFFVRKQKLVFEGKELARDKLCVRDYGVSDGNVLHLVLRLSDLQAITVRTECGKEFGFYVGKKRNVGYVKQQIARKGQGLLDLADQELVWEGEALEDQRLIEDICKDNDAVIHFLVRTSDAKVTTKPVGKDFELSIEAYTVPSFSAGQLGSVSVTNRALKRNELTREFLLEPIVVNPKIKIPQVIQELIKITSEGLEKGGKPIQSSEGSGGAYLMQDSLGLKYVSVFKPIDEEPMAINNPRGLPLSVDGEGGLKKGTRVGQGALREVAAYILDHPKKGPRSYHNSDEKGFAGVPPTVMVKCLHKGFHHPEGYNSASDNVKLGSLQMFMKNIGSCEDMGPSVFPVEEVHKISVLDIRLANADRHAGNILVAKDGENGSTVLIPIDHGYCLPESFEDCTFDWLYWPQAKEPYSPDTIEYIKSLDAEEDIKLLKFHGWELPPECARLLRISTMLLKKGAEKGLPPFTIGSIMCRETLKKKSVIEQIIEEAEEGALPGTSEASFLDLVSVIMDSHLEEPFP

SEQ ID NO: 4909 - protein, 583 aa, Glycine max
MACVALHPVCEESLNRGEFTSCFSPHLRESILIYLTVGGSVIPMHIMKTDSIASVKLRIQTFKGFFVKKQKLVFEGKELARNRSCIRDYGVGDGNVLHLVLRLSDLKAITVRTMCGKEFGLYVEKSRSVGYVKQQIAKKGQGFLDHKDQELICEGEELEDQRLIEDICKDNDAVIHFLVRKSDAKVRTKPVDKDFELSIEASYVHNLVPNLHADQLGSVSVTNEVLERSQLTRDFVLEPIIMNSNIKIPLVIQELIKSTSEGLEKGCKPIQSSEGSGGAYLMQDSSGLKYVSVFKPIDEEPMAINNPRGLPVSEDGEGLKKGTRVGQGALREVAAYILDHPRKGPRSYYNNEEGGFAGVPPTVMVKCLDKGFHNIEDYQNDSANVKIGSLQMFMRNIGSCEDMGPSAFPVEEVHKISVLDIRLVNADRHAGNILIARDGEDGQTILIPIDHGYCLPESFEDCTFDWLYWPQAKEPYSPDTIDYIKSLDAEEDIKLLKFHGWDLPPKCAQILRISTMLLLKGAERGLTPFALGSIMCRETLKKKSVIEQIVEEAEEAAFPGASEAAFLDLVSVVMDSHLDELFP

SEQ ID NO: 4910 - protein, 287 aa, Unknown
  Sequence found in Organisms: Solanum tuberosum, Solanum phureja
MFRRKNHSNSEQGVEDQQQKVKELRASLGQLSGRSTQFCTDACLKRFLEARNWNVDKAKKMLEETLKWRLSFKPEEIRWNEVAKEGETGKVFKANFHDRHGRTVLILRPGMQNTAALDNQMKHLVYLIENAIFNLPEGQEQMVWLIDFTGWSITNNVPVKSARESINILQNHYPERLAAAILYNPPRLFETFWRIVKYFMDPKTFQKVKFVYPKNKDSAELMKSYFDVDNLPTEFGGTATLNYDHEEFSRLMAQDDVKAAKFWGKDKHPPGPGGNGSYSAVEVAPEP

SEQ ID NO: 4911 - protein, 157 aa, Solanum tuberosum
MLEETLKWRLSFKPEEIRWNEVAKEGETGKVFKANFRDRHGRTVLILRPGMQNTAALDNQMKHLVYLIENAIFNLPEGQEQMAWLIDYTGWSITNNVPVKSARETINILQNHYPERLAAAILYNPPRLFETFWRIVKYLMNLKTFQKVKFVYPKNND

SEQ ID NO: 4912 - protein, 295 aa, Solanum melongena
MFRRKNHSHSEQEGEDHQHKVKELRASLGLLSGRSAQFCTDACLKRYLEARNWNVDKSKKMLEETLKWRLSFKPEEIRWSEVAIEGETGKVFKANFHDRYGRTVLILRPGMQNTSSLDNQMKHLVYLIENAIFNLPEGQEQMAWLIDFTGWSITNNVPVKSARETINILQNHYPERLAAALLYNPPRIFETFWKIVKFFMDPKTFQKVKFVYPKNKDSVELMKSYFDVDNLPTEFGGTATLKYDHEEFSRQMAQDDVKVAKFWGLDKHPPGANGGGYSAVEVAPEPESLALPATV

SEQ ID NO: 4913 - protein, 295 aa, Capsicum annuum
MFRRKNHSHSEQQGEDQQHKVKELKASLGQLSGRSALYCTDTCLKRYLEARNWNVDKAKKMLEDTLKWRLSFKPEEIRWNEVAIEGETGKVYKANFHDRYGRTVLILRPGMQNTSALDNQMKHLVYLIENAIFNLPEGQEQMAWLIDFTGWSIANNVPVKSARETINILQNHYPERLAVAFLYNPPRIFEAFWKIVKYFMDPKTFQKVKFVYPKNKDSVELMKSYFDVDNLPTEFGGTATLNYDHEEFSRQMAQDDVKVAKFWGFDKHPPGANGYSAVEVAPEPEAVALPATARA

SEQ ID NO: 4914 - protein, 293 aa, Nicotiana tabacum
  misc_feature (111)..(111): Xaa can be any naturally occurring amino acid
  misc_feature (194)..(194): Xaa can be any naturally occurring amino acid
MFRRKNHSNIEQEGEEKQHKVKELRASLGPLSGRSSQYCTDACLRRYLEARNWNVDKSRKMLEETLKWRSSFKPEEIRWHEVAIEGETGKVYKANFHDRYGRTVLILRPGXQNTSALDNQMKHLVYLIENAILNLPEGQEQMAWLIDFTGWSITNNVPIKSARETINILQNHYPERLAVAFLYNPPRIFEAFWXIVKYFMDPKTFQKVKFVYPKNKDSVELMKSFFDVDNLPTEFGGSATLNYDHEEFSRQMAQDDVKAAKFWGFDKHQSDANGFSAAEVAPEPESIASPAIA

SEQ ID NO: 4915 - protein, 294 aa, Solanum phureja
MFRRKSHPHSEQEGEDQPHKVKELRTSLGAPLSGRDLQYCNDACLRRYLEARNWNVEKSKKMLEETLKWRSTFKPEEIRWHEVAIEGETGKAYRANFHDRHGRTVLILRPGMQNTTALDNQMRHLVYLIENAILNLPQDQEQMSWLIDFTGWSLTNNVPIKSARETVNILQNHYPERLAVAFLYNPPRIFEAFWKIVKYFLDPKTMQKVKFVYPKNKDSVELMKSYFDMDNLPTELGGKANLKYDHEEFSRQMAQDDVKAAKFWSFDKHHTETNGYSAPEVAPKTECLAPPVKV

SEQ ID NO: 4916 - protein, 262 aa, Solanum phureja
MEHEDSYKGVSEPKYDCLLFDVDDTLYPLSSGISAQCTKNIIDYMIEKLGIDETKVPEMCIRLYKEYGTTMAGLRAIGYDFDYDDYHSFVHGRLPYELLKHDHVLRNLLHSLPVRKVIFSNANEAHVAKVLSRLGLEDCFDDIVCFETVNPTNNGSVQDNNNGVSPRSLIVCKPFEEAYEQAFKIANINPQKTLFFDDSVRNLQTAKLTGLHTVWVGASHRTEGIDYALESIHNMKEALPELWEDVKPDIRYSEKTAIEVRA

SEQ ID NO: 4917 - protein, 259 aa, Capsicum annuum
MEHEDSYKRVLEPKYECLLFDVDDTLYPLSSGISAQCTKNIIDYMIEKLGIDETKVPEMCISLYKEYGTTMAGLRAIGYDFDYDDYHSFVHGRLPYELLKHDPVLRNLLRSLPVRKVIFSNANEAHVAKVLSRLGLEDCFDDIICFETLNPTNNDNKSNVESPRSLIVCKPFEEAYEQAFKIANINPQKTLFFDDSVRNLQTAKLTGLHTVWVGASHRTKGIDNALESIHNMKEALPELWEDVKPDIRYSEKTAIEVRV

SEQ ID NO: 4918 - protein, 418 aa, Solanum phureja
MVRNRREELYVTVPSLFRCPISMDVMKSPVSLCTGVTYDRSSIQTWLSQGHNTCPATMQILPSTDFTPNLTLRRLINVWIQHQPASSPGSTTPSSSSVTKSEVVEIVKSLNGEVDRLSSLAKIVEFVKCSGENRRFFVNLSDAIVSVVGVLVDCDVVEVCEAVVAVLDLVVSENEVKEQLNKEILKSDRKFLPKFLLILRKGKLSSRIQTARILEFIALDADSQRKMVEEQGLLYELHVFTSTETNRFAIEAGLSTLIAVSTTRPAKKELVRFGIVQTIGKILSGSETARAVVEKSLKLLETVATCTEGRSAIGKGEECLSVIVTRLMKSSKAATEHGVTVLWSVCCLFRDTEAREVVGKANGLTKVLLVMQSDCSAGVRQMCGELVKALRVVNNKDKNYSKSCLASYDTKTTHIMPY

SEQ ID NO: 4919 - protein, 418 aa, Solanum tuberosum
MVRNRREELYVTVPSLFRCPISMDVMKSPVSLCTGVTYDRSSIQTWLSQGHNTCPATMQILPSTDFTPNLTLRRLINVWIQHQPASSPGSTTPSSSSVTKSEVVEIVESLNGEVDRLSSLAKIVEFVKCSGENRRFFVNMSDAIVSVVGVLVDCDVVEVCEAVVAVLDLVVSENEVKEQLNKEILKSDRKFLPKFLLILRKGKLSSRIQTARILEFIALDADSQREMIEEQGLLYELHVFTSTETNRFAIEAGLSTLIAVSTTRPAKKELVRFGIVQTIGKILSGSETARVVVEKSLKLLETVATCTEGRSAIVKGEECLSAIVTRLMKSSKAATEHGVTVLWSVCCLFRDTAAREVVGKANGLTKVLLVMQSDCSAGVRQMCGELVKALRVVNNKDKNYSKSCLASYDTKTTHIMPY

SEQ ID NO: 4920 - protein, 418 aa, Solanum tuberosum
MVRNRREELYVTVPSLFRCPISMDVMKSPVSLCTGVTYDRSSIQTWLSQGHNTCPATMQILPSTDFTPNLTLRRLINVWIQHQPASSPGSTTPSSSSVTKSEVVEIVKSLNGEVDRLSSLAKIVEFVKCSGENRRFFVNMSDAIVSVVGVLVDCDVVEVCEAVVAVLDLVVSENEVKEQLNKEILKSDRKFLPKFLLILRKGKLSSRIQTARILEFIALDADSQREMIEEQGLLYELHVFTSTETNRFAIEAGLSTLIAVSTTRPAKKELVRFGIVQTIGKILSGSETARVVVEKSLKLLETVATCTEGRSAIVKGEECLSAIVTRLMKSSKAATEHGVTVLWSVCCLFRDTAAREVVGKANGLTKVLLVMQSDCSAGVRQMCGELVKALRVVNNKDKNYSKSCLASYDTKTTHIMPY

SEQ ID NO: 4921 - protein, 419 aa, Capsicum annuum
MVRNRREELYVTVPSLFRCPISMDVMKSPVSLCTGVTYDRSSIQTWLSQGHNTCPATMQILPCTDFTPNLTLRRLINVWLQHQTTTASSLGAVTPSLSAVTKSEVVEIVKSINGEISQLSNLVKIVEFVKCSGENRRFFVNLSDAIVNVVGVLVDCDEVEICESVVAVLDLVVSENGVKEQLNNEILRSDRRVLPKLLSIFRKGKLSSRIQTARILEFIASDADSQRKIVEEQGLLHELHVFTSTETNRFAIEAGLSTLIAVSTTRLAKKELIRFGIVQAIGKVLTGSETARPVVEKSLKLLETVATCTEGRTAIGKCEECLSAIVTRLMKSTRAATEHGVAVLWSVCSLARDAAAREVVRKVNGLTKVLLVMQSDCSAGVRQMCGELVKALRVGNNNKNYSKSCLASYDTKTTHIMPY

SEQ ID NO: 4922 - protein, 420 aa, Nicotiana benthamiana
MMRNRREELYVTVPSLFRCPISMDVMRSPVSLCTGVTYDRSSIQTWLSQGHNTCPATMQILPSTDFTPNLTLRRLINVWLQHQPANSPSASTTLSSSSAVSKSEVLEIVKNLNGENRLSSLVKIADFVKYSDDNRRFFVNSSGAIANVVDVLVDSDVVEICESVFAVLDLVVLENGVKEELNKEVLRSDRAFLSKFLLILRKGKLSSRIQSARILEFIALDADSQRKIVEDQGLLYELHVFTRTETNRFAVEAGLSALISISTTRPTTKELVRFGIVQTLGKILSRSDSARAVVEKSLKLLETVATCTEGRAAIGKGEECLTAVVTRLMKSSRAATEHGVTVLWSVCCLARDSAAREVVGKVNGLTKVLLVMQSDCSSGARQICGELVKALRVVNNNNSKNYSKSCLASYDTKTTHIMPY

SEQ ID NO: 4923 - protein, 360 aa, Solanum phureja
MSSGGEKKNVVVIGGGVAGSVVAKTLKSEVNVSLIDEKEYYEITWASLRCMVEPEFAKRSVISHSEYLPHAKIIPSAAVDITDTDVLTKQGSRIAYDYLVVATGHTQSGAEARTEKISQYQAEYEKIKAADSILIVGGGPTGVELAAEIVADFPAKKVTLVHRGSRLLEFIGESASKKALNWLTSKKVEVILEQSVVVNSQSDGVYRTSGGETIVADCYFLCTGTLFGSAWLKETILKDSLDSRGRVMVDSNLRIKGRNNIFAIGDITDVPELKQGYLAQEHAKVVAKNITSLIKGVEDDHKLAVYKPATKALAIVSLGRKDAVAQFPCLSIAGRVPGMIKSGDLFVGKTRKGLGLQPGV

SEQ ID NO: 4924 - protein, 358 aa, Capsicum annuum
MSLGGEKKNVVVTGGGAAGSVVAKTLQNEANVSLIDEKEYFEITWASLRSMVEPEFAKRSVVSHSEYLPHAKIISSAAVDITDIDVLTKQGSRIAYDYLVVATGHTQSGAWTKTEKISQYQAEYEKIKAANSILIVGGGPTGVELAAEIAADFPAKKLTLVHRGSRLLEFIGQSASNKALNWLTSKKVEVILGQSVDVNSPTDGVYQTSGGETVVADCHFLCIGTPFGSAWLKETILKDSLDSSGRVMVDSNLRIKGRNNIFAIGDITDIPELKQGYLAQEHAKVVAKNITSLIKGVEDDHKLAVYKPATKALAIVSLGRKDAVAQFPCLSIAGRIPGMIKSGDLFVGKTRKGLGLSS

SEQ ID NO: 4925 - protein, 237 aa, Solanum tuberosum
MAAPSVQEVLPPSLDSTSQPPSLFDGTTRLYISYQCPYAQRVWITRNVKGLQDKINLVPIDLQNRPDWYKEKVYPPNKVPSLEHNNKVIGESLDLVKYIDSNFEGPSLLPDDPEKQKFAEELIAYSDTFVPEIYRSFMRDAQTLAGAQFDYLEKALGKFDDGPFFLGQFSQVDIAYVPFIERFQIFMPAGFNYDITSGRPKLAKWIEEMDKLDGYKQTKVLEPEKLVEYYKNLFLKA

SEQ ID NO: 4926 - protein, 100 aa, Solanum phureja
MRDAQTLAGAQFDYLEKALGKFDDGPFFLGQFSQVDIAYVPFIERFQIFIPAGFNYDITSGRPKLAKWIEEMDKLDGYKQTKVLEPEKLVEYYKNLFLKA

SEQ ID NO: 4927 - protein, 237 aa, Solanum melongena
MAAPSVQEVLPPSLDSTSQPPPLFDGTTRLYINYQCPFAQRVWITRNAKGLQGKIKLVPIDLQNRPDWYKEKVYPPNKVPSLEHNNKVIGESLDLVKYVDSNFEGPSLLPDDPEKRKFAEELIAYSDTFVPEVYRSFTRDARTLAGAQFDYLEKALDKFDDGPFFLGQFSQVDIVYAPFIERFQIFMSGAFDYDITSGRPKLAKWIEEMDKLDAYKQTKVLEPEKLVEYYKKRFLQA

SEQ ID NO: 4928 - protein, 250 aa, Solanum phureja
LMGLFFYLHRIVQEVLPPTLDSTSQPPSLFDGTTRLYINYQCPYSQRVWITRNVKGLQEKIKLVPIDLKNRPDWYKEKVYPTNKVPSLEHNNKVIGESLDLVKYVDSNFEGPSLTPDDPEKRKFAEELIAYSDTTFVPEVYRSFAKDARTLAGAQFDYLEKALLKFDDGPFFLGQFSQVDIAYAPFIERFQVFMPEGFDYDITTGRHKLAKWIEEMNKLDGYKQTKVLEHEKMVEYYKNRFLPVLTLQIL

SEQ ID NO: 4929 - protein, 250 aa, Solanum phureja
LMGLFFYLHRIVQEVLPPTLDSTSQPPSLFDGTTRLYINYQCPYSQRVWIARNVKGLQEKIKLVPIDLKNRPDWYKEKVYPTNKVPSLEHNNKVIGESLDLVKYVDSNFEGPSLTPDDPEKRKFAEELIAYSDTTFVPEVYRSFAKDARTLAGAQFDYLEKALLKFDDGPFFLGQFSQVDIAYAPFIERFQVFMPEGFDYDITTGRHKLAKWIEEMNKLDGYKQTKVLEQEKMVEYYKNRFLPVLTLQIL

SEQ ID NO: 4930 - protein, 224 aa, Capsicum annuum
MAAPNVQEVLPPSLDSTSQPPSLFDGTTRLYINYQCPYAQRAWITRNFKGLQDKIELVPIDLQNRPAWYKEKVYPPNKVPSLEHNNKVIGESLDLIKYIDSNFEGPSLLPDDPEKRKFAEELIAYSDTFVPEVYGSFKKDVQTLAGAQFDYLEKALHKFDYGPFFLGQFSQVDIAYVPFIERFQIFLQEVFNYDITSGRPKLAKWIEEVNKLDGYKQTKVLDPK

SEQ ID NO: 4931 - protein, 250 aa, Solanum phureja
LMGLFFYLHRIVQEVLPPTLDSTSQPPSLFDGTTRLYINYQCPYSQRVWITRNVKGLQDKIKLVPIDLKNRPDWYKEKVYPTNKVPSLEHNNKVIGESLDLVKYVDSNFEGPSLLSDDPEKRKFAEELIAYSDTTFVPDVYRSFAKDARTLAGAQFDYLEKALLKFDDGPFFLGQFSQVDIAYAPFIERFQVFMPEGFDYDITTGRPKLAKWIEEMNKLDGYKQTKVLEQEKMVEYYKNRFLPVLTLQIL

SEQ ID NO: 4932 - protein, 549 aa, Solanum phureja
MVQKRNINQDNDENSEFPSRESKRQHPSNAFFSGLRSYSSPQELALRLEPSIRSWVREEIERTLQSTLRSSLNDDKTSQSRAIQLLFDDILPSSLFTGSNVSRDNRPIKVLLHDASSNQRITSGPLSSAKVDVVVLNGEFNPNDLEDWSEEEFSKKVIRAREGKRPLLTGDLIIQLRDGVGYLGDISFTDNSSWVKSRTFRLGLKLINRSGEFRVREGVSKPFTVRDHRGEAYKKHYPPTLDDEIWRLEKIAKDGASHKRLSNEGISCVKEFLRLFVTDPSLLRKMLACGNNIWEKITEHVSTCPLDNSEWYIYNAGESIVLLFNCIYELVGAILDGQNFQSIDKLDVFQKRMVEDFKRSVYKNLNCLAPLEDRSLIGQAALTSNLQNGLSHIPSSSQQNMNYSDEQGQVEFQSNSDHATISSPLAYTAQQDSPTAVSMPESFHGMQAFNSTLANSFLVGDPCSSIYPGDYDWGSNGSFDSLGMSDYLPPNNNYQFETPVWQGNGLLASSSVQPVSPNIGIHITRRGNPRAIWCTIRAVLKWKTLVKRK

SEQ ID NO: 4933 - protein, 317 aa, Solanum tuberosum
MVPSSIEHSGESASGENQRSLPTPFLTKTYQLVDDSAMDELISWNDDGTTFIVWKPAEFARDLLPKYFKHNNFSSFVRQLNTYGFRKIVPDRWEFANDCFRRGEKGLLRDIQRRKISPACTVVSAVVAPAVAVNAAQAVTVAVAPAVRMVSSSNSGDEQVLSSNSSPAATAAAMLRTTTCTTTQELIEENERLRKENAQLNQELNRLRSLCNNVYNLMSNYSVNPADIPARIPEGRALELLDGSGAAFTAAEEDISPRLFGVSIGVKRVKRSNEEESDTVEDQDQVQPHGSDMESEPLDSGSAHHDDQPWIYRLDLG

SEQ ID NO: 4934 - protein, 330 aa, Nicotiana benthamiana
MVPSPVEQTGESVAGENQRSLPTPFLTKTYQLVDDPAIDELISWNEDGTTFIVWKPAEFARDLLPKYFKHNNFSSFVRQLNTYGFRKVVPDRWEFANDCFRKGEKGLLRDIQRRKISPAGTAVTAVSPTVAVNAAQAVTIAVAPAARLVSPSNSGDEQVLSSNSSPAATAAAAAVLRTTTCTTTPELLEENERLRKENAQLSQELNRLRSLCNNVYNLMSNYTGNPSEMPAGIPEGRALELLPAGQVAAEMDGGATATPAECSGVKAEEDISPRLFGVSIGAKRVRRSNEEESEREGIVQDQVQLHGSDVKSEPLDSGSGHHNGQPDRLG

SEQ ID NO: 4935 - protein, 222 aa, Solanum tuberosum
MNVLMIKLCFFLVLISNGYSTKLDSYPPTCQRIECPNYDVIESVKDYEIRRYNSPMWMSTEPIDDISFVSATRTGFLRLFKYIQGKNDKHDKIEMTAPVMTQVKPSDGPLCSTSFIVSFNVPKKNQPNPPSAEGLHPQKWNESSYAAVRQFSGFASDAVIPKEAAALSASIAGTKWAAAIEKSRGKDNSTLYTVEQYNSPFEFRGRVNEMWFTFVMDSAIAI

SEQ ID NO: 4936 - protein, 218 aa, Solanum phureja
MIKVCFFLVLISNGYSTKLDSYPPTCQRIECPNYDVIESGKDYEIRRYNSPMWMSTEPIDDISFVSATRTGFLRLFMYIQGKNDKHEKIEMTAPVMTQVMPSDGPLCSTSFVVSFYVPKNNQQNPPSAEGLHPQKWNESSYAAVRQFSGFASDGDIPKEAAALSASIAGTKWAAAIEKSRSKDNSTLYTVAQYNSPFEFRGRVNEMWFTFVMDSAIAI

SEQ ID NO: 4937 - protein, 262 aa, Solanum tuberosum
  misc_feature (209)..(209): Xaa can be any naturally occurring amino acid
PRADSARGKYSLVKMNVLMIKLCFFLVLISNGYSTKLDSYPPTCQRIECPNYDVIESVKDYEIRRYNSPMWMSTEPIDDISFVSATRTGFLRLFKYIQGKNDKHDKIEMTAPVMTQVKPSDGPLCSTSFIVSFNVPKKNQPNPPSAEGLHPQKWNESSYAAVRQFSGFASDAVIPKEAAALSASIAGTKWAAASKKAGVKIIVHFIQLXNTTPRLSSGAELMRCGLLLLWTVQLPFERLLFKNKVYYHIFLFCIINSIVEKS

SEQ ID NO: 4938 - protein, 147 aa, Solanum phureja
MAIFGDPFRRFLLSPTIYRSFSGSPALLDWIESPNSHIFKINVPGYSKEDIKVQVEDGNVLVVKAEGHGGKKDEFHGKDKDVVWHVAERGGGRGRGGDFSREIELPEDVKVDQIKAQVENGVLTIVVPKDATPKTSKVRNINITSKL

SEQ ID NO: 4939 - protein, 145 aa, Solanum melongena
MAIFGDPFRRFLLSPTIYRTFSGSPALLDWIESPNAHIFKINVPGYSKEDIKVQVEDGNVLAVKAEGRGGKKDEFHGKEKEIVWHVAERGGGKDGDFSREIELPEDVKVDQIKAHVENGVLTIIAPKEATPKTFKVRNINITSKL

SEQ ID NO: 4940 - protein, 147 aa, Capsicum annuum
MSIFGDPFRRFLLSPTIYRTSYGSNALLDWIESPNAHIFKINVPGYSKEDIKVQVEDGNVLVVKAEDRGGKKDEYHGKDKEIVWHVAERSGGGKGGGDFSREIELPEDVKVDQIKAQVENGVLTIVVPKDATPKPSKVRNINITSKL

SEQ ID NO: 4941 - protein, 142 aa, Nicotiana tabacum
MALFGDPFRQFLLSPTIYRSSSGSAALLDWFESPNSHIFKINVPGYNKKDIKVQVEDGNVLVVKAEGGGKKDEFHGKEEIVWHGAERGGGKGDFSREIELPEDVKVDQIKAQVKNGVLTIVVPKDATPKPSKVRNINITSKL

SEQ ID NO: 4942 - protein, 143 aa, Petunia hybrida
MALFGDPLRRFLWSPTIYGTSPGSAALLDWLESPNAHVFKINVPGYSKEDIKVQVEDGNVLVVKAEGGGKKDEFHGKEKDIVWHVAERGGGKGDFSREIELPEDVKVDQIKAQVDNGVLTILVPKDATPKPSKVRNINITSKL

SEQ ID NO: 4943 - protein, 235 aa, Solanum phureja
MKKHHIFQEDHQNSSGSSLAMSSSFGTSTPERHSSFSQDSESTASALHSPSSSDYSPRVTPSQDDSAVIIQKRKLGKKAKSYAYRIREHVKLGSKFSETVKGKLNIVKEGGRRNIFRHMFNVNDGEKLLKASQCYLYTTTGPIAGILFISTDKIAFCSERPIAVPCPSGGILRTPYKVVIPVTKIKRAHPSVNENKPSQKYIEIVTEDNFEFWFMGFVRYEKAFLNLQKAISMSN

SEQ ID NO: 4944 - protein, 234 aa, Solanum melongena
MNKHHNFQEDHLNSSGSSLAMSSSFGTTTPERHSSFSQDSESTLHSPSSSDHYSPTIITPSHDDSAVIIQKRKLGKKAKSYAYRIREHVKLGPKFSETVKGKLKIVKEGGRKNIFRHMFNVNEGEKLLKASQCYLYTTAGPIAGILFISTHKIAFCSERPISVPFPSGGILRTPYKVVIPVKKIKRAHPSVNENKPSQKYMEIVTEDNFEFWFMGFVRYEKAFLNLQKAISMSF

SEQ ID NO: 4945 - protein, 232 aa, Solanum tuberosum
MKKHHIDHQNSSCSSLAMSSSFGTSTPERHSSFSQDSESAASALHSPSSSDYSPRVTPSQDDSAVIIQKRKLGKKAKSYAYRITEHVKLGSKFSETVKGKLNIVKEGGRRNIFRHMFNVNDGEKLLKASQCYLYTTAGPIAGILFISTDKIAFCSERPIAVPCPSGGILRTPYKVVIPVTKIKRAHPSVNENKPSQKYIEIVTEDNFEFWFMGFVRYEKAFLNLQKAISMSN

SEQ ID NO: 4946 - protein, 236 aa, Capsicum annuum
MKEHQNNFHEDHNVNYSGSSLAMSSSFGTTPERHSSFSQDSESGSPLHSPSSSDYSPRIITPSQDDSAVIIQKKKLGKKAKSYAYRIREHVKLGPNFSETVKGKLKIVKEGGRRNIFKHMFNVNEGEKLLKASQCYLYTTAGPIAGILFISTHKIAFCSERPIAVPFPSGGILRTPYKVVIPVTKIKRAHASVNENKPSQKYIEIITEDNFEFWFMGFVRYEKAFLNLQKAISMSN

SEQ ID NO: 4947 - protein, 246 aa, Nicotiana tabacum
QITRISKILKLNMKENHYQFEDQQNYCGSSSAMSSSFGTTPERHSSFSQDSETVSSLHSSSSSDNYSPRVTPSQDDSAIIVHKRKLGKKAKSYAYRIREHVKLGPKFSETVKGKLKIVKEGGRRNIFRNMFNVNEGEKLLKASQCYLYTAAGPIAGILFISTEKIAFCSERPIAVPFPSGGILRTPYKVVIPVKKIKRAYASVNENKPSQKYIEIVTEDNFEFWFMGFVRYEKAFLNLQKAISMSN

SEQ ID NO: 4948 - protein, 274 aa, Solanum tuberosum
MAEDGHKVILNVYDLSQGLARQLSTTFLGKAIEGIWHTGVVVYGHEYYFGGGIQHAPAGTTPYGTPIQVVDLGVTHIPKDVFEMYLQEISPRYTAETYSLLTHNCNNFSNEIAQFLVGATIPDYILNLPNEVTNSPMGALIMPMIQQLESTLRANAVPQAPQFRPATVAPASQPTLSVGKSSSSGVYQSKKPESQDGEKKNVPSAVKPVGEQEKTPANGVVKDPLGDARSKVQEEITREFAAIMATGTLRASEAAALATKKVMQRYGDTFAAMN

SEQ ID NO: 4949 - protein, 274 aa, Solanum tuberosum
MAEDGHKVILNVYDLSQGLARQLSTTFLGKAIEGIWHTGVVVYGHEYYFGGGIQHAPAGTTPYGTPVQVVDLGVTHIPKDVFEMYLQEISPRYTAETYSLLTHNCNNFSNEIAQFLVGATIPDYILNLPNEVTNSPMGALIMPMIQQLESTLRANAVPQAPQFRPATVAPASQPTLSVGKSSSSGVYQSKKPESQDGEKKNVPPAVKPVGEQEKTPANGVVKDPLGDARSKVQEEITREFAAIMATGTLRASEAAALATKKVMQRYGDTFAAMN

SEQ ID NO: 4950 - protein, 274 aa, Solanum phureja
MAEDGHKVILNVYDLSQGLARQLSTTFLGKAIEGIWHTGVVVYGHEYYFGGGIQHAPAGTTPYGTPVQVVDLGVTHIPKDVFEMYLQEISPRYTAETYSLLTHNCNNFSNEIAQFLVGATIPDYILNLPNEVTNSPMGALIMPMIQQLESTLRANAVPQAPQFRPATIAPASQPTLSVGKSSSSGVYQSNKPESQDGEKKNVPPAVKPVGEQEKTPANGVVKDPLGDARSKVQEEITREFAAIMATGTLRASEAAALATKKVMQRYGDTFAAMN

SEQ ID NO: 4951 - protein, 274 aa, Solanum tuberosum
MAEDGHKVILNVYDLSQGLARQLSTTFLGKAIEGIWHTGVVVYGHEYYFGGGIQHAPAGTTPYGTPVQVVDLGVTHIPKDVFEMYLQEISPRYTAETYSLLTHNCNNFSNEIAQFLVGATIPDYILNLPNEVTNSPMGALIMPMIQQLESTLRANAVPQAPQFRPATIAPASQPTLSVGKSSSSGVYQSNKPESQDGEKKNVPPAVKPVGEQEKTPANGVVKDPLGDARSKVQEEITREFAAIMANGTLRASEAAALATKKVMQRYGDTFAAMN

SEQ ID NO: 4952 - protein, 277 aa, Solanum melongena
MAEDGHKVTLNVYDLSQGLARQLSTTFLGKSIEGIWHTGVVVYGNEYYFGGGIQHAPAGTTPYGTPVQFVDLGVTHVPKDVFEMYLQEISPRYTAETYSLLTHNCNNFSNEIAQFLVGATIPDYILNLPNEVTNSPMGALIMPMIQQLESTLRANAVPQAPQFRSPTVAPASLPAPSGGKSSSSGVDISKKPESQDGEKKNANVPSTVKSVGKEEKTSADAAAVKDPLGNARSKVQEEITREFAAIMATGTLRASEAAALATKKVMQRYGDTTAAMN

SEQ ID NO: 4953 - protein, 275 aa, Capsicum annuum
MAEDGHKVTLNVYDLSQGLARQLSTTFLGKAIGGIWHTGVVVYGHEYYFGGGIQHAPAGTTPYGTPVQVVDLGVTHVPKDVFEMYLQEISPRYTAETYSLLTHNCNNFSNEIAQFLVGATIPDYILNLPNEVMNSPMGALIMPMIQQLESTLRANAVPQAPQFRPHTDDPASQPTLSGGKSSSSHVEQSKSAKSQDGEKNAIVPPVVKSVGEHEKTPANSAKKDPLGDARSKVQEEITREFAAIMATGTLRASEAAALATKKVMQRYGDTTAAMN

SEQ ID NO: 4954 - protein, 267 aa, Nicotiana tabacum
MAEEGHKVSLNVYDLSQGLARQLSTTFLGKAIEGIWHTGVVVYGHEYYFGGGIQHAPAGTTPYGTPIRVVDLGVTHVPKDVFEMYLQEISPRYTAETYSLLTHNCNNFSNEVAQFLVGATIPDDILNLPNEVMNSPMGALIMPMIQQLESTLRANAVPQAPQFRPPTVASASQPMVSGGKSQVGEDKSGSVVKPAKREEKPVGEQEKTPANTAVRDPLGDSRSKVQEEITREFAAIMATGTLRASEAAALATKRVMQRYGHTTAALN

SEQ ID NO: 4955 - protein, 199 aa, Solanum phureja
MEEIIGEKKMKILCLHGFRTSGNFLKKQLSKWDPSIFAHFEMEFPDGIFAAGGKSDIEGIFPPPYFEWFQYNEDFTEYENLEECISYLCEYITSKGPFDGLLGFSQGATLSGLLLGYMEQGKILKEHPPMKLFVSISGAKFRDPNICNIAYKDMMKVKSVHFIGEKDWLKLPSQELTTAFENPLIIRHPQGHTVPRLGK

SEQ ID NO: 4956 - protein, 257 aa, Solanum melongena
MEEIIGEKKMKILCLHGFRTSGNFLRKQLSKWDPSIFAHFEMDFPDGIFEAGGKSDIEGIFPPPYFEWFQYNEDFTEYGNLEECISYLCEYITSKGPFDGLLGFSQGATLSALLLGYMEQGKILKEHPPMKLFVSISGAKFRDPNICNIAYKDVMKVKSVHFIGEKDWLKLPSQELTTAFENPLIMRHPQGHTVPRLDEAAVETLKTWTSKIVLSYNQSCLDGGPNEASKHVNIENGLEEAKKTEKPNEIEIQKAQE

SEQ ID NO: 4957 - protein, 185 aa, Solanum tuberosum
  misc_feature (185)..(185): Xaa can be any naturally occurring amino acid
MEFPDGIFAAGGKSDIEGIFPPPYFEWFQYNEDFTEYENLEECISYLCEYITSKGPFDGLLGFSQGATLSGLLLGYMEQGKILKEHPPMKLFVSISGAKFRDPNICNIAYKDIMKVKSVHFIGEKDWLKLPSQELTTAFENALIIKHPQGHTVPRLDEAAVETLKTWTREIGLSSNESCLGGGPX

SEQ ID NO: 4958 - protein, 269 aa, Solanum phureja
MADSSKDDFLQLLKRIGAFLTLKISNLSQTLDSRSAGAIAGLAFAIVFIWRILRSPSGPQRRHPKQQAVTPGSSGVSRHFSENIPTSEVSPPSEDSNAQNVIDEFFQPIKPTLGQIVRQRLGEGRKVTCRLLGVILEETSPEELQKQATVRSSALEVLLEITKFCDLYLMERVLDDESEKKVLLALEDAGVFTSGGIVKDKVLFCSIENGRTSFVRQLEPDWHIDTNPEIVFQLARFIKYELHITPTKSERTAMNVFSSTSLEQFFGTA

SEQ ID NO: 4959 - protein, 268 aa, Capsicum annuum
MADTSKDDLVELIKRIGAFLTLKFSNLSLTLDSRSIGAIAGLAFTIVFAWRILRTSSPQRRSPKRQAVIPGSSGVSSHFSENIATSEVSPPSEDSSAQNVIDEFFQPVKPTLGQIVRQRLSEGRKVTCRLLGVILEETSPEELQKQATVRSSVLEVLLEITKFCDLYLMERVLDDESEKKVLLALEDAGVFTSGGMVKDKVLFCSIENGRTSFVRQLEPDWHIDTNPEIVFQLARFIKYELHITPTKSERTAMNVFSSTSLEQFFGTV

SEQ ID NO: 4960 - protein, 269 aa, Capsicum annuum
MGDYSKDDFLQLVKRFGAFLTVKISNLLHTLDSRSVGAIAGLAVAIVFTWRVWRSPSAPQRRIPKRQGATPSSSGVSNHSSANAATSGVISTSEDSNAQNVIDEFFQPVKPTLGQIVRQRLREGRKVTCRLLGVILEETSPEELQQQATVRSSVLEVLLEITKFCDLYLMERVLDDESEKKVLLALENAGVFTSGGLVKDKVLFCSTENGRTSFVRQLEPDWHIDTNPEITFQLARFIKYQLHVSPTKPERTAINVFNSITFEQFFGNV

SEQ ID NO: 4961 - protein, 269 aa, Solanum lycopersicum
MGDSSKDDFLQLIKRFGAFLTVKISNIFHTLDSRSVGAIAGLAVAIVFTWRVWRSPSGPQRRIPKRQGTTPSSSGVSTHSSANVETSGVISSSEDSNAQNVIDEFFQPVKPTLAQVVRQRLSEGRKVTCRLLGVILEETSPEELQQQATVRSSVLEVLLEITKFCDLYLMERVLDDESEKKVLLALENAGVFTSGGLVKDKVLFCSTEIGRTSFVRQLEPDWHIDTNPEITFQLARFIKYQLHVSPTKPERTAINVFNSTTLEQFFGNV

SEQ ID NO: 4962 - protein, 269 aa, Solanum tuberosum
MGDYSKDDFLQLIKRFGAFLTVKISNLFHTLDSRSVGAIAGLAVAIVFTWRVWRSPSEPQRRIPKRQGATPSSSGVSTHSSANVETSGVTSSSEDSNAQNVIDEFFQPVKPTLAQVVRQRLSEGRKVTCRLLGVILEETSPEELQQQATVRSSVLEILLEITKFCDLYLMERVLDDESEKKVLLALENAGVFTSGGLVKDKVLFCSTEIGRTSFVRQLEPDWHIDTNPEITFQLARFIKYQLHVSPNKPERTAINVFNSTTLEQFFGNV

SEQ ID NO: 4963 - protein, 269 aa, Solanum phureja
MGDYSKDDFLQLIKRFGAFLTVKISNLFHTLDSRSVGAIAGLAVAIVFTWRVWRSPSEPQRRIPKRQGATPSSSGVSTHSSANVETSGVTSSSEDSNAQNVIDEFFQPVKPTLAQVVRQRLSEGRKVTCRLLGVILEETSPEELQQQATVRSSVLEILLEITKFCDLYLMERVLDDESEKKVLLALENAGVFTSGGLVKDKVLFCSTEIGRTSFVRQLEPDWHIDTNPEITFQLARFIKYQLHVSPTKPERTAINVFNSTTLEQFFGNV

SEQ ID NO: 4964 - protein, 267 aa, Nicotiana tabacum
  misc_feature (55)..(55): Xaa can be any naturally occurring amino acid
  misc_feature (60)..(61): Xaa can be any naturally occurring amino acid
  misc_feature (83)..(83): Xaa can be any naturally occurring amino acid
  misc_feature (87)..(87): Xaa can be any naturally occurring amino acid
  misc_feature (95)..(95): Xaa can be any naturally occurring amino acid
  misc_feature (105)..(105): Xaa can be any naturally occurring amino acid
  misc_feature (166)..(166): Xaa can be any naturally occurring amino acid
MADKDDFLQLIKRFGAFLTVKISNLLHSLDSRSVGAIAGLAFAVVFTWRLWRSPXGPQRXXPKRQAATSSSSGVRNHSSANVXTSGXTPSSEDSXAQNVIDEFFXPVKPTLGQIVRQRLSEGRKVTCRLLGVILEETNPEELQQQATVRSSVLEVLLEITKFCDLXLMERVLDDESERKVLLALENAGVFTSGGLVKDKVLFCSTEIGRTSFVRQLEPDWHIDTNPEITFQLARFIKYQLHVSATKPERTAINVFNSTSLEQFFGSV

SEQ ID NO: 4965 - protein, 185 aa, Solanum tuberosum
MTTKEMEVVKNLDVEKYMGRWYEIASFPSRNQPKDGVNTRATYTLNQDGTVHVLNETWSGGKRGSIEGTAYKVDPKSDEAKLKVKFYIPPFLPIIPIVGDYWVLYIDDDYQYALIGQPSKKYLWILCRQPHLDEEIYNQLVEKAKEVGYDVSKLHKTPQADPPPDGEDAPKDTKGIWWIKSILGK

SEQ ID NO: 4966 - protein, 185 aa, Solanum tuberosum
MTTKEMELVKNLDVEKYMGRWYEIASFPSRNQPKDGVNTRATYTLNQDGTVHVLNETWSGGKRGSIEGTAYKVDPKSDEAKLKVKFYIPPFLPIIPIVGDYWVLYIDDDYQYALIGQPSKKYLWILCRQPHLDEEIYNQLVEKAKEVGYDVSKLHKTPQADPPPDGEDAPKDTKGIWWIKSILGK

SEQ ID NO: 4967 - protein, 181 aa, Solanum tuberosum
MEVVKNLDVEKYMGRWYEIASFPSRNQPKDGVNTRATYTLNQDGTVHVLNETWSGGKRGSIEGTAYKVDPKSDEAKLKVKFYIPPFLPIIPIVGDYWVLYIDDDYQYALIGQPSKKYLWILCRQPHLDEEIYNQLVEKAKEVGYDVSKLHKTPQADPPPDGEDAPKDDTKGIWWIKSILGK

SEQ ID NO: 4968 - protein, 180 aa, Solanum phureja
MEVVKNLDVEKYMGRWYEIASFPSRNQPKDGVNTRATYTLNQDGTVHVLNETWSGGKRGSIEGTAYKVDPKSDEAKLKVKFYIPPFLPIIPIVGDYWVLYIDDDYQYALIGQPSKKCLWILCRQPHLDEEIYNQLVEKAKEVGYDVSKLHKTPQADPPPDGEDAPKDTKGIWWIKSILGK

SEQ ID NO: 4969 - protein, 185 aa, Capsicum annuum
MTTKEMEVVRNLDVERYMGRWYEIASFPSRFQPKDGVDTRATYSLNPDGTIHVLNETWSGGKRGSIEGTAYKADPKSDEAKLKVKFYLPPFLPIIPITGDYWVLYIDHDYQYALIGQPSKKYLWILCRQPHLDEGIYNQLVEKAKEVGYDVSKLHKTPQADPPPESEDAPKDTKGIWWLKSIFGK

SEQ ID NO: 4970 - protein, 184 aa, Solanum melongena
MTTKEMEVVRNLDVERYMGRWYEIASFPSRNQPKDGVNTRATYSLNPDGTVHVLNETWSGGKRGSIEGTAYKVDPKSDEAKLKVKFYVPPFLPIIPITGDYWVLYIDADYQYALIGQPSKNYLWILCRQTHLDDEIYNMLVNKAKEVGYDVSKLHKTPQADPPPESEGPEDKKGIWWIKSIFGK

SEQ ID NO: 4971 - protein, 185 aa, Nicotiana tabacum
MSTKEMEVVRNLDVERYMGRWYEIASFPSRNQPKNGVNTRATYSLNPDGTVHVLNETWSDGKRGSIEGTAYKADPKSDEAKLKVKFYIPPFLPIIPIVGDYWVLYIDNDYQYALIGQPSRNYLWILCRKTHLDEEIYNMLIEKAKEVGYDVSKLHKTPQSDPPPEGDDSPQDTKGIWWLKSIFGK

SEQ ID NO: 4972 - protein, 185 aa, Nicotiana tabacum
MTTKEMEVVRNLDVERYMGRWYEIACFPSRNQPKNGVDTRATYTLNPDGTVHVLNETWSNGKRGSIEGTAYKADPKSDEAKLKVKFYVPPFLPIIPITGDYWVLYIDNDYQYALIGQPSRNYLWILCRRNHLDEEIYNMLIEKAKEVGYDVSKLHKTPQSDPPPESENAPQDSKGIWWIKSIFGR

SEQ ID NO: 4973 - protein, 185 aa, Solanum lycopersicum
MATKVMEVVKNLDLKRYMGRWYEIASFPSRFQPKDGVDTRATYTLNSDGTVHVLNETWCNGKRGFIEGTAYKADPNSDEAKLKVRFYVPPFLPIIPVTGDYWVLYIDEDYQYALIGQPSRRYLWILSRQTRLDDEIYNQLVEKAKEEGYDVSKLHKTPQSDSPPDSEDSPKDTKGIWWIKSILGK

SEQ ID NO: 4974 - protein, 185 aa, Carica papaya
MAKKEMEVVKGLDIKRYMGRWYEIASFPSRFQPKDGVNTRATYTLNDDGTVHVLNETWSGGKRGYIEGTAYKADPNSDEAKLKVRFYIPPFLPIIPVTGDYWVLYIDDDYRYALIGQPARKYLWILCRETHMDEEIYNQLVQRATDEGYDVSKLHKTPQSDPPPEGDEGPKDTKGIWWIKSIFGK

SEQ ID NO: 4975 - protein, 185 aa, Triphysaria pusilla
MATKEMEVVKGLNIEKYMGRWYEIASFPSRFQPKNGADTRATYTLNPDGTVHVLNETWSNGKRGFIEGSAYKADPKSDEAKLKVKFYVPPFLPIIPVTGDYWVLYIDEDYQHALIGQPSRSYLWILSRQPKLDEEIYNQFVEKAKEVGYDVSKLHKTPQSETAPDSEDSEKDTKGIWWIKSIFGK

SEQ ID NO: 4976 - protein, 186 aa, Antirrhinum majus
MANKEMEVVKNLDISRYMGRWYEIASFPSRFQPKNGVDTRATYTLNPDGTTVHVLNETWSDGKRGYIEGSAYKADPNSDEAKLKVKFYVPPFLPIIPVVGDYWVLYIDEDYQHALIGQPSRRYLWILSRQAHLDDEIYNQLVEKAKGEGYDVSKLHKTPQSETPPDSEDAPKDTKGIWWIKSIFGR

SEQ ID NO: 4977 - protein, 185 aa, Theobroma cacao
MSQKPMEVVKHLDINRYMGRWYEIASFPSRFQPRGGVNTRATYTLREDGTVHVLNETFTDGKRGYIEGTAYKADPKSDEAKLKVKFYVPPFLPIIPVVGDYWVLFIDDDYQYALIGQPSRKYLWILCRQPHMDDEIYNQLVQKAKDEGYDVSTLHKTPQSDPPPEGEETPKDTKGIWWIKSIFGK

SEQ ID NO: 4978 - protein, 185 aa, Solanum tuberosum
MATKVMEVVKNLDLKRYMGRWYEIASFPSRFQPKDGVDTRATYTLNSDGTVHVLNETWCNGKRGFIEGTAYKADPNSDEAKLKVRFYVPPFLPIIPVTGDYWVLYIDEDYQYALIGQPSRRYLWILSRRTCLDDEIYNQLVEKAKEEGYDVSKLHKTPQSDSPPESEDSPEDTKGIWWIKSILGK

SEQ ID NO: 4979 - protein, 185 aa, Triphysaria pusilla
MATKEMEVVKGLNIEKYMGRWYEIASFPSRFQPKNGADTRATYTLNPDGTVHVLNETWSNGKRGFIEGSAYKADPKSDEAKLKVKFYVPPFLPIIPVTGDYWVLYIDEDYQHALIGQPSRSYLWILSRQPKLDDEIYNQFVEKAKEVGYDVSKLHKTPQSETAPDSEDSEKDTKGIWWIKSIFGK

SEQ ID NO: 4980 - protein, 187 aa, Ricinus communis
MAAAKNEMEVVKGLDIKRYMGRWYEIASFPSRFQPKNGVNTRATYTLNEDGTVHVLNETWSDGKRGYIEGTAYKANPKSDEAKLKVKFYVPPFLPIIPVVGDYWVLYLDDDYSYALIGQPSRNYLWILCRRTHLDDEIYNQLVEKAKEEGYDVSKLHKTQQSDPPPEGEEGPKDTKGIWWIKSILGR

SEQ ID NO: 4981 - protein, 184 aa, Ipomoea nil
MGSTKEMEVVRNLDVERYMGRWYEIASFPSRFQPKDGVDTRATYTLNPDGTVHVLNETWSGGKRGYIEGTAYKADPKSDEAKLKVRFYVPPFLPIFPVTGDYWVLHIDPDYQYALIGQPSRSYLWILCRQPRLDDETYNELVEKAKEVGYDVSKLHKTPHSETPPEGEVASDKGIWWIKSIFGK

SEQ ID NO: 4982 - protein, 184 aa, Ipomoea nil
  misc_feature (161)..(161): Xaa can be any naturally occurring amino acid
MGSTKEMEVVRNLDVERYMGRWYEIASFPSRFQPKDGVDTRATYTLNPDGTVHVLNETWSGGKRGYIEGTAYKADPKSDEAKLKVRFYVPPFLPIFPVTGDYWVLHIDPDYQYALIGQPSRSYLWILCRQPRLDDETYNELVEKAKEVGYDVSKLHKTPHXETPPEGEVASDKGIWWIKSIFGK

SEQ ID NO: 4983 - protein, 169 aa, Petunia hybrida
MGRWYEIASFPSRFQPRNGENTRATYTLNEDGTVHVLNETWTNGERGYIEGTAYKADPKSDEAKLKVKFYVPPFLPIIPVVGDYWVLSIDDKYQYALIGQPSRSYLWVLCRQTSLDEGTYNELVEKAKEEGYDVSKLHKTPQSDRPPESEEALKDDTKGIWWIKSILGK

SEQ ID NO: 4984 - protein, 185 aa, Gossypium hirsutum
MSQKTMEVVKNLDIKRYMGRWYEIASFPSRFQPRNGVNTRATYTLNEDGTVHVLNETFTDGKRGFIEGTAYKADPQSDEAKLKVKFYVPPFLPIIPIVGDYWVLYLDDDYQYALIGQPSRNYLWVLCRQTHMDDEIYNQLVQKAKDEGYDVSKLHKTPQSDPPPEGDDTPKDTKGIWWIKSLLGM

SEQ ID NO: 4985 - protein, 184 aa, Capsicum annuum
MASKVMEVVKNLDLKKYIGRWYEIASFPSRFQPKDGADTRATYTLNQDGTIHVLNETWCNGKRDYIEGTAYKADPKSDEAKLKVKFYVPPFLPVIPVVGDYWVLYIDEDYQYALIGQPSRRYLWILCRRPHLDDEIYNQLVEKGKAEGYDVSKLRKTPQSDSPPSEDGPKDDKGIWWIKSILGK

SEQ ID NO: 4986 - protein, 182 aa, Vaccinium corymbosum
KEMEVVKGVDLERYMGRWYEIASFPSRFQPKNGINTRATYTLKEDGTVNVLNETWNDGKRGYIEGTAYKADPNSDEAKLKVKFYVPPFLPIIPVVGDYWVLYLDSDYQYALIGQPTRKYLWILCRQNHLDEEIYNQLLEKAKEEGYDVSKLHKTTQTDPPPEADEGPKDTKGIWWIKSILGK

SEQ ID NO: 4987 - protein, 185 aa, Gossypium hirsutum
MSQKTMEVVKNLDIKRYMGRWYEIASFPSRFQPRNGVNTRATYTLNEDGTVHVLNETFTDGKRGFIEGTAYKADPQSDEAKLKVKFYVPPFLPIIPIVGDYWVLHLDDDYQYALIGQPSRNYLWVLCRQTHMDDEIYNQLVQKAKDEGYDVSKLHKTPQSDPPPEGDDTPKDTKGIWWIKSLLGM

SEQ ID NO: 4988 - protein, 185 aa, Arachis hypogaea
MAEKEMSVVRNLDVKRYMGRWYEIASFPSRFQPKNGVDTRATYTLNEDGTVHVLNETWSDGKRGFIEGTAYKADPNSDEAKLKVKFYVPPFLPIIPVTGDYWVLFIDDDYQYALIGQPSRRYLWILSRQNRLDEEIFNELVQKAKDVGYDVSKLHKTPQSETPPEGEEGPKDTKGIWWIKSILGR

SEQ ID NO: 4989 - protein, 185 aa, Solanum phureja
MATKVMEVVKNFDLKRYMGRWYEIASFPSRFQPKDGVDTRATYTLNSDGTVHVLNETWCNGKRGFIEGTAYKADPNSDEAKLKVRFYVPPFLPIIPVTGDYWVLYIDEDYQYALIGQPSRRYLWILSRRTCLDDEIYNQLFEKAKEEGYDVSKLHKTPQSDSPPESEDSPEDTKGIWWIKSILGK

SEQ ID NO: 4990 - protein, 184 aa, Juglans hindsii x Juglans regia
MAKKEMEVVKGLDLNRYMGRWYEIASFPSRFQPKNGENTRATYTLKDDGTVNVLNETWSDGKRGYIEGTAYKADTNSDEAKLKVKFYVPPFLPIIPVVGDYWVLYLDDDYGYALIGQPSRKYLWILCRQTHMDEEIYNQLVQRAKDEGYDVSKLHKTPQSDPPPEGEGPSDTKGIWWFKSILGK

SEQ ID NO: 4991 - protein, 185 aa, Populus trichocarpa
MATKKEMEVVKGVDLKRYMGRWYEIASFPSRFQPKNGVNTRATYTLNEDGTVHVLNETWNDGKRGYIEGSAYKADPNSDEAKLKVKFYVPPFLPIIPVVGDYWVLSLDEDYQYALIGQPSRKYLWILCRKTHMEDEIYNQLVEKAKEEGYDVEKLHKTPQTDPPPEEEGPKDTKGIWWIKSILGK

SEQ ID NO: 4992 - protein, 185 aa, Castanea mollissima
MAKKEMEVVKGVDLNRYMGRWYEIASFPSRFQPKNGANTRATYTLKEDGTVNVLNETWTDGKRGYIEGSAYKADPNSDEAKLKVKFYVPPFLPIIPVVGDYWVLYLDDDYQYALIGQPSRKYLWILCRQTHLDEEIYNQLVQKAIDEGYDVSKLHKTPQSDPPPSEEEGPKDTKGFWYFKSLLGK

SEQ ID NO: 4993 - protein, 185 aa, Lactuca sativa
MSKKAMEVVKGIDLKRYMGRWYEIASFPSRFQPKDGINTRATYTLRDDGTVNVLNETWSGGKRGFIEGTAYKADPKSDEAKLKVKFYVPPFLPIIPVVGDYWVLYLDDDYQYALIGQPSRSYLWILCRQTHLDDEIYNKLVEKATEEGYDVSKLKKTTQTEPPPESEDAPADTKGIWWFKSLFGK

SEQ ID NO: 4994 - protein, 185 aa, Lactuca sativa
MSKKAMEVVKGLDLQRYMGRWYEIASFPSRFQPKDGINTRATYTLKDDGTVNVLNETWSGGKRGFIEGTAYKADPKSDEAKLKVKFYVPPFLPIIPVTGDYWVLYLDDDYQYALIGQPSRSYLWILCRQTHLDDEIYNQLVQKATEEGYDVSKLKKTTQTEPPPESEDAPADTKGIWWFKSLFGK

SEQ ID NO: 4995 - protein, 188 aa, Elaeis guineensis
MATTSTKEMTVVKGLDVERYMGRWYEIASFPSFFQPKNGENTRATYTLNSDGTVHVLNETWSDGKRDAIEGTAYKANPNSDEAKLKVKFYVPPFFPIIPVTGDYWVLYIDDDYQYALIGQPSRKYLWILCRQTHMDDEVYNLLLEKAKEEGYDVKKLHKTPQADPPPEAEAGPKDTKGIWWIKSLFGK

SEQ ID NO: 4996 - protein, 185 aa, Populus trichocarpa
MATKKEMEVVKGVDLKRYMGRWYEIASFPSRFQPKNGVNTRATYTLNEDGTVHVLNETWNDGKRGYIEGSAYKADPNSDEAKLKVKFYVPPFLPIIPVVGDYWVLSLDEDYQYALIGQPSRKYLWILCRKTHMEDEIYNQLVEKAKEEGYDVEKLHKTPQTDPPPEEEGPKDTKGIWWFKSILGK

SEQ ID NO: 4997 - protein, 185 aa, Taraxacum officinale
MSKKAMEVVKGIDLQRYMGRWYEIACFPSRFQPKNGVNTRATYTLNDDGTVHVLNETWSDGKRGFIEGTAYKADPKSDEAKLKVKFYVPPFLPIIPVTGDYWVLHLDDDYQYALIGQPSRSYLWILCRQTHIDEEIYNKLVEKAKEEGYDVSKLKKTPQSESPPESKDAPADTKGIWWLKSIFGK

SEQ ID NO: 4998 - protein, 185 aa, Quercus alba
MANKEMEVVKGVDLNRYMGRWYEIASFPSRFQPKNGVNTRATYTLREDGTVNVLNETWTDGKRGYIEGSAYKADPNSDEAKLKVKFYVPPFLPIIPVVGDYWVLYLDDDYQYALIGQPTRKSLWILCRQTHLDEEIYNQLLQKATDEGYDVSKLHKTPQSDPPPSGEEGPKDTKGFWYFKSLLGK

SEQ ID NO: 4999 - protein, 185 aa, Cichorium intybus
MSKKEMEVVKGLDVQRYMGRWYEIASFPSFFQPKNGVNTRATYTLNDDGTIHVLNETWSDGKRDSIEGTAYKADPKSDEAKLKVKFYVPPFLPIIPVTGDYWVLFICENYQYALIGQPSRKYLWILCRQTHIDDETYNQLVQKAIDEGYDVSKLKKTPQADPPPESTDAPADTKGIWWLKSIFGK

SEQ ID NO: 5000 - protein, 185 aa, Lactuca sativa
MSKKAMEVVKGIDLQRYMGRWYEIASFPSRFQPKDGINTRATYTLKDDGTVNVLNETWSGGKRGFIEGTAYKADPKSDEAKLKVKFYVPPFLPIIPVTGDYWVLYLDDDYQYALIGQPSRSYLWILCRQTHLDDEIYNQLVQKATEEGYDVSKLKKTTQTEPPPESEDAPADTKGIWWFKSLFGK

SEQ ID NO: 5001 - protein, 185 aa, Mimulus guttatus
MAKKAMEVVKCLDVERYMGRWYEIASFPSRFQPKSGADTRATYTLNPDGTVHVLNETFSDGKRGFIEGSAYKVDPNSDEAKLKVKFYVPPFLPIIPVTGDYWVLHIDDDYQYALVGQPTRKYLWILSRQPRLDEEIYNQLLEKAKEEGYDVSKLQKTAQSETPPESESAPKDTKGVWWIKSILGK

SEQ ID NO: 5002 - protein, 187 aa, Eschscholzia californica
MAAKKEMEVVKDLDVKRYMGRWYEIASFPSRFQPKNGVNTRATYTLNEDGTTVHVLNETWSDGKRGFIEGTAYKANPNSTEAKLKVKFYVPPFLPIIPVVGDYWVLTIDDDYSYALIGQPSRNYLWILCRNTHLDEEIYNQLVEKAIAEGYDVKKLHKTPQSDPPPEGDETPKDTKGIWWFKSLFGK

SEQ ID NO: 5003 - protein, 186 aa, Curcuma longa
MAKQEEMTVVKGLDLERYMGRWYEIASFPSRFQPRDGQDTRATYTLRSDGTVNVLNETWSGGRRGSIEGTAYKADPSSDEAKLKVKFYVPPFLPIFPVVGDYWVLYIDDDYQYALIGQPSRSYLWILCRQTHLDEEVYNMLVEKAKEVGYDVQKLHKTPQTDPPPEADTAPRDTKGIWWIKSLFGR

SEQ ID NO: 5004 - protein, 185 aa, Tropaeolum majus
MANQMQVVKGLDVKRYMGRWYEIASFPSRFQPKDGENTRATYTLNEDGTIHVLNETWSGGKRSFIEGTAYKADPNSDEAKLKVKFYVPPFLPIIPVTGDYWVLFIDDDYNYALIGQPSRKYLWILCRQPHLDEGIYNQLVERAKDVEGYDVTKLHRTPQSDTPPEGDEGPKDTKGIWWFKSLLGK

SEQ ID NO: 5005 - protein, 186 aa, Tamarix hispida
MGNNKEMKVVKGLDVKRYMGRWYEIASFPSFFQPRNGENTRATYTLNSDGTIHVLNETWSSGKRDAIEGTAYKADPKSDEAKLKVKFYVPPFLPIIPVVGDYWVLYIDDDYQYALIGQPSRKYLWILCRQTHMDDEIYNQLVQRALDEGYDVKKLHKTPQADPPPESDDGPKDTKGVWWIKSLFGK

SEQ ID NO: 5006 - protein, 185 aa, Manihot esculenta
MASSKKMEVVKGVDIKRYMGRWYEIASFPSRFQPKNGENTRATYTLNEDGTVHVLNETWSDGKRGYIEGTAYKADPNSDEAKLKVKFYVPPFLPIIPVVGDYWILFLDEDYSYALIGQPSRRYLWILCRRPHLDEKTYNQLVERAKEEGYDVSKLHKTPQAETPPEEDGPKDTKGIWWIKSILGW

SEQ ID NO: 5007 - protein, 184 aa, Heritiera littoralis
MSKKTMDVVKNLDINRYMGRWYEIASFPSFFQPRNGVNTKATYTLNEDGTVHVLNETFTDGKRVSIEGSAYKADPKSDEAKLKVKFYVPPFLPIIPVVGNYWVLFIDDDYQHVLIGEPTRKYLWILCRQTHLDDEIYNQLVQKAKDEGYDVSKLHKTPQSDPPPGEDTPKDTKGIWWIKSIFGK

SEQ ID NO: 5008 - protein, 185 aa, Quercus alba
MANKEMEVVKGVDLNRYMGRWYEIASFPSRFQPKNGVNTRATYTLREDGTVNVLNETWTDGKRGYIEGSAYKADPKSDEAKLKVRFYVPPFLPIIPVVGDYWVLYLDDDYQYALIGQPTRKSLWILCRQTHLDEEIYNQLLQKATDEGYDVSKLHKTPQSDPPPSGEEGPKDTKGFWYFKSLFGK

SEQ ID NO: 5009 - protein, 185 aa, Actinidia deliciosa
MAKKEMEVVKGLDLERYMGRWYEIASFPSRFQPKSGINTRATYTLREDGIVNVLNETWTDGKRGFIEGTAYKADPKSDEAKLKVKFYVPPFLPIIPVVGDYWVLFIDDDYQYALIGQPSRKYLWILCRQNHIAEETYKQLVQRAKDEGYDVSKLHQTTHTDPPPEGEDGPKDTKGIWWFKSIFGK

SEQ ID NO: 5010 - protein, 185 aa, Lactuca sativa
MSKKAMEVVKGIDLQRYMGRWYEIASFPSRFQPKDGINTRATYTLKDDGTVNVLNETWSGGKRGFIEGTAYKADPKSDEAKLKVKFFVPPFLPIIPVTGDYWVLYLDDDYQYALIGQPSRSYLWILCRQTHLDDEIYNQLVQKATEEGYDVSKLKKTTQTEPPPESEDAPADTKGIWWFKSLFGK

SEQ ID NO: 5011 - protein, 185 aa, Mimulus guttatus
MAKKAMEVVKCLDVERYMGRWYEIASFPSRFQPKSGADTRATYTLNPDGTVHVLNETFSDGKRGFIEGSAYKVDPNSDEAKLKVKFYVPPFLPIIPVTGDYWVLHIDDDYQYALVGQPTRKYLWILSRQTRLDEEIYNQLLEKAKEEGYDVSKLQKTAQSETPPESESAPKDTKGVWWIKSILGK

SEQ ID NO: 5012 - protein, 205 aa, Quercus alba
MANKEMEVVKGVDLNRYMGRWYEIASFPSRFQPKNGVNTRATYTLREDGTVNVLNETWTDGKRGYIEGSAYKADPNSDEAKLKVKFYVPPFLPIIPVVGDYWVLYLDDDYQYALIGQPTRKSLWILCRQTHLDEEIYNQLLQKATDEGYDVSKLHKTPQSDPPPSGEEGPKDTKGFWYFKSLFGKIGRIVVVCIPWFDCFQYIHK

SEQ ID NO: 5013 - protein, 185 aa, Quercus alba
MANKEMEVVKGVDLNRYMGRWYEIASFPSRFQPKNGVNTRATYTLREDGTVNVLNETWTDGKRGYIEGSAYKADPNSDEAKLKVKFYVPPFLPIIPVVGDYWVLYLDDDYQYALIGQSTRKSLWILCRQTHLDEEIYNQLLQKATDEGYDVSKLHKTPQSDPPPSGEEGPKDTKGFWYFKSLLGK

SEQ ID NO: 5014 - protein, 1349 aa, Solanum phureja
MLLRSYAYLLRKPSPYIAVFLVPTVVLVTQQGDALMLHTDLKVGKYWGEMGVDYWDAATWQQQVDDHEVLVMTPAILLAALRHSFLQIDMIKVIIFDECHNARGKHPYASIMVEFYHHQLTHESAQLPRIFGMTASPIKSKGASTAHSYWQKIRDLENLMNSKVYTCSSESVLAEYIPFSNPKLKIYEHVDIPCTLFNTLAQDLERLKEKHECSISKSNLSSMSAGSARRRLSKLHLAFLFCLSEMGVWLAFKAAEFLSFEENDFFSWGEFDACAQTIVRNFSLGASKIFSARLPSGPHWSIGGDIQANADAGYLSSKVNCLLESLLEYRDRKDLRCIIFVERIVTAIVLRSLLNELLLERSGWRTEYTAGHISVLQSQSRKNQNKIVEEFRKGLVNIIVATSILEEGLDVQSCNLVIRFDPSATVCSFIQSRGRARMQNSDFLLMVRDGDDPTLTRMQNYMASGEIMRQESLRHASIPCSPLDDELYDEPCYKVESTGAVVTLSSSVSLLYFYCSRLPSDGYFKPNPRCVIDKETGTCTLQLPKSSPLQRVISVQGNRKILKQLACLEACKELHHVGALTDNLVPDIVEEEAINKELECQIHTVEESKYFPPELVSHCSNDSEAVYYCYLVEMQHASYNDFQLHGIILAVRTRLKCDDEILAFDLDVDRRGLLQVQLNYSKVVTLTAEEIRRCQRFQVSVFRVLRDRDLSKLQDALAAVQLPIGSAVSDYLLLPSLGSTPEINWKCVNSLLFPSQVLEDKHMDWCSTQDRKRSVNIKTGVVCSCMLENSLVFTPHNGHIYCITGFLDNLDCYSLLGMRTGESITYTEYYKKRHGINICFEEEPLLRGKHICKVHNYLQRSRTQKAKDSTDSSVELPPELCSLIMSPLSISTLNTYSYVPSIMHRIESLVMASNLKRTHLDHRTLNVPIPTAKILEAITTKKCLEKFHLESLETLGDSFLKYAASIKLFKTYENHHEGLLTVKKNQIISNAALCKLGCARKIPGFIRNEPFDLKAWIIPGDNSQVHSFDDEFLTSSDKMYSRVKQKIKSKRVADVVEALIGAYLSSGGEVAALSFMKWLGVDINFVDAPMSRHFPMNAEKLVNVRYLESLLHYKFNDPSLLVEALTHGSYMLPEIPRCYQRLEFLGDAVLDYVVTAHLYSKYPGLTPGLITDLRSASVNNECYAQSAVKAGLHKHILHASQDLQRQICSTVEDFDKLNLVSTFGWEAETTFPKVLGDVIESLGGAIFVDSGFDKDTTFQCIRPLLEPLVTPQTLKPHPVRELTELCDQKGYIKKKDVVCRENGIAYITVEVEANGVIHKSTCSGRDKLMGRKVASKNVLKSLKECPSNA

SEQ ID NO: 5015 - protein, 1373 aa, Solanum lycopersicum
MLLRSYAYLLRKPSPYIAVFLVPTVVLVTQQGDALMMQTDLKVGTYWGEMGVDFWDAATWKRQVDGHEVLVMTPAILLSALRHNFLQIDMIKVIIFDECHNARGKHPYASIMMEFYHRQLTRESAQLPRIFGMTASPIKSKGPSTPDSYWRKIHDLENLMHSKVYTCDSEAVLAEYIPFSNPKLKIYKHVDIPSTLSKSLAHDMERLKEKHECSITKSTLSDKSAASAKRRLSKLYSAFLFCLSEMGVWLAFKAAEFLSQQETDFFSWGELDVCAQTIVRDFSSDASKVFSACLPSGPHWSIGGDIQANTDAGYLSSKVHCLVESLLEYRNLKDLRCIIFVERIITAIVLRSLLNELLPKLSGWRTECTAGHASVVQSQSRKIQNKIVEEFRKGVVNIIVATSILEEGLDVQSCNLVIRFDPSATVCSYIQSRGRARMQNSDFLLMVKRYILCNIWKRFHYIYGLIISQFDSNRSGDESTLARMQNFMASGEMMRQESLRHASEPCSPLVDEMYDEPCYKVESTGAIITLSSSVSLLYFYCSRLPSDGYFKSYPRCVIDKESRTCTLQLPKSCPLQRIITVQGNSTKILRQLACLEACKELHRVGALTDNLVPDIVEEEAINKELECQIHTVEESKYFPPEFVSHFGNETEAVYYCYLVELQHETYDDFQLHGIILAVRTKLKCDDEILAFDLDVDRRRRVQVQLKYSKVVTLTSEEIRRCQRFQVSVFKILLDRDLSKLQDALAAGQSPIGSAVSDYLLLPSVGKSSEINWKCVNSLLFPSQVLGDKHMDWCSTQDRKRSVNTKTGVVCSCLLENSLVFTPHNGNIYCITGFLDNLDCNSLLNVRTGESITYREYYKKRQGIELCFEEPLLSGKRISKVHNYLQRNRTQKAKDSTDSSVQLPPELCFVIMSPISISTLYTYSYVPSIMHRIESLVMASHLNSMLLNDCKLNVFIPTAMVLEAVTTRKCLEKFHLESLETLGDAFLKYAVSTQLFKTHENHHEGLLCVKKSKIISNAALCKLGCARKIPGFIRNEAFTLQAWIIPGDSSQVHSFNEELMTSSDKMYSRIKQKIRSKRVADVVEALIGAYLSSGGEVAALSLMKWLGMDIDFADAPIQRHFPLNAEKLVNVKYLESLLHYKFHDPSLLVEALTHGSYMLPEIPRCYQRLEFLGDAVLDYVVTAHLYFKYPGLSPGLITDLRSASVNNECYAQCAIKASLHKHILHASPDLQRQICNTIEDFKNPVSTFGWEAETTFPKVLADVIESLAGAIFVDSGFNQDTTFQCIRPLLEPLVTPQTLKPHPVRELSELCDQKGYVKKKDVVSRENGVAYITVEIDADGVTHKSTCSGRDKIMAKKVACKNVLKSLKECSYNA

SEQ ID NO: 5016 - protein, 223 aa, Solanum phureja
MALDLHFQEQITESTFNECRSSPSQKWKTLDDERDEDNRASGFDCNICLDVVKDPVVTFCGHLYCWPCIYKWIQFQSASDHQKPQCPVCKAKVSQKELIPLYGPGQATKPSEDDVTSKGMVIPQRPLRPRCSGDHTLIATTNSLPSQQLNHRQQPHSGGYIASPPVIGEVVYARVFGNACPNSYNLVGNTSLRMRRQLLHADRSLGRLYFFLICCVLACLLLF

SEQ ID NO: 5017 - protein, 191 aa, Solanum tuberosum
MALDLHFQEQITESTFNECRSSPSQKWKTLDDERDEDNRASGFDCNICLDVVKDPVVTFCGHLYCWPCIYKWIQFQSASDHQKPLCPVCKAKVSQKELIPLYGPGQATKPSEDDVTSKGMVIPQRPLRPRCSGDHTLMATTNSLPSQQLNHRQQAHSGGYIGSPTVIGEVVYARVLEMHVQTRITLQETRV

SEQ ID NO: 5018 - protein, 191 aa, Solanum tuberosum
  misc_feature (85)..(85): Xaa can be any naturally occurring amino acid
  misc_feature (132)..(132): Xaa can be any naturally occurring amino acid
  misc_feature (138)..(138): Xaa can be any naturally occurring amino acid
  misc_feature (155)..(155): Xaa can be any naturally occurring amino acid
  misc_feature (162)..(162): Xaa can be any naturally occurring amino acid
  misc_feature (165)..(165): Xaa can be any naturally occurring amino acid
  misc_feature (187)..(187): Xaa can be any naturally occurring amino acid
  misc_feature (190)..(190): Xaa can be any naturally occurring amino acid
MALDLHFQEQITESTFNECRSSPSQKWKTLDDERDEDNRASGFDCNICLDVVKDPVVTFCGHLYCWPCIYKWIQFQSASDHQKPXCPVCKAKVSQKELIPLYGPGQATKPSEDDVTSKGMVIPQRPLRPRCXGDHTLXATTNSLPSQQLNHRQQXHSGGYIXSPXVIGEVVYARVLEMHVQTRITLXETXV

SEQ ID NO: 5019 - protein, 205 aa, Solanum phureja
MALDLHFQEQITESTFNECRSSPSQKWKTLDDERDEDNRASGFDCNICLDVVKDPVVTFCGHLYCWPCIYKWIQFQSASDHQKPQCPVCKAKVSQKELIPLYGPGQATKPSEDDVTSKGMVIPQRPLRPRCSGDHTLIATTNSLPSQQLNHRQQPHSGGYIASPPVIGEVVYARVFGNACPNSYNLVGNTSLRMRRQLLHADRSL

SEQ ID NO: 5020 - protein, 281 aa, Solanum tuberosum
MTGTGEENQPKFQQSEPQIPSVSSSSSDPQAPEMDQQKWGTHIMGPPAIPTSHPDNQKAALWRAEDQREEFQPLPYVVYSPIDKSSNNPLESVVNVFNSWSNRAENIGRNIWYNLKAGPSVRGAAWGKLNMTAKALTEGGFEPLYKQIFEADPNEQLKKTFACCLSTATGPVAGTLYLSTTKVAFCSDRPLSFKAPSGQEAWSYYKVAIPLGNIGTINPIVMRESPPEMYIQIVTIDGHDFWFMGFVNFEKAKHHLLETLSIFRAQPPHVGEVNVQQPATY

SEQ ID NO: 5021 - protein, 281 aa, Solanum phureja
MTGTGEENQPKFQQSEPQIPSVSSSSSDPQAPEMDQQKWGTHIMGPPAIPTSHPDNQKAALWRAEDQREEFQPLPYVVYSPIDKSSNNPLESVVNVFNSWSNRAENIGRNIWYNLKAGPSVRGAAWGKLNLTAKALTEGGFEPLYKQIFEADPNEQLKKTFACCLSTATGPVAGTLYLSTTKVAFCSDRPLSFKAPSGQEAWSYYKVAIPLGNIGTINPIVMRESPPEMYIQIVTIDGHDFWFMGFVNFEKAKRHLLDTLSIFRAQPPHVGEVNVPQPATY

SEQ ID NO: 5022 - protein, 281 aa, Solanum melongena
MTGTGEEHQPKVEESHAQVPSASASSSDPQAPEVDQQKWGTHIMGPPAVPTCHPDNQKAALWRAEDQREEFHPQPYVVYSPIDKPSNNPLESVVNMFNSWSNRAETIARNIWHNLKAGPSVTEAAWGKLNLTAKALTEGGFDPLYKQIFAADPHEQLKKTFACYLSTATGPVAGTLYLSNTKVAFCSDRPLSFKAPSGQEAWSYYKVAIPLGNIGTINPIVMRENPPERYIQIVTIDGHDFWFMGLVNFEKAKHHLLETLSNFRAQPPHVGEVNVPQTATT

SEQ ID NO: 5023 - protein, 263 aa, Solanum tuberosum
MTGTGEENQPKFQQSEPQIPSVSSSSSDPQAPEMDQQKWGTHIMGPPAIPTSHPDNQKAALWRAEDQREEFQPLPYVVYSPIDKSSNNPLESVVNVFNSWSNRAENIGRNIWYNLKAGPSVRGAAWGKLNMTAKALTEGGFEPLYKQIFEADPNEQLKKTFACCLSTATGPVAGTLYLSTTKVAFCSDRPLSFKAPSGQEAWSYYKVAIPLGNIGTINPIVMRESPAEMYIQIVTIDGHDFWFMGCVNFEKAKRHLLDTLSNF

SEQ ID NO: 5024 - protein, 284 aa, Capsicum annuum
MTGTTEENQPKVQESEPQAPSIPTSSSSDEKEKQPEMDQQKWGTHIMGPPAVPTSHPDNQKAAALWRAADQKEEFHPQPYVVYTPVDHRPTNNPLESVVNMFNSWSNRAETIARNIWHNLRTGPSVTEAAWGKLNLTAKALTEGGFEPLYKQIFSTDPNEQLKKTFACYLSTTTGPVAGTLYLSSTKVAFCSDRPLSFKAPSGQEAWSYYKVAIPLTNIGTMNPIVMRENPPERYIQIVTIDGHDFWFMGFVNFEKATHHLLDALSNFKAQPPHVGEVPQPASN

SEQ ID NO: 5025 - protein, 668 aa, Solanum phureja
MSDLQLYGLDDISWDEFCHNDDHIVPHPSSGRTNEPLSQNDSRKKPRHEVIGLTGNAGDQSTGKYANQQKEQVLSNRSPKMLEKDSWADAPDGAFSSPREKAIVGEVSSLPSENTRTSNRCIKSNNIDSIENESCPNGRTLDDKNAAVGENSYSYPLGPISQADDDLSFLDNSCDDKDSNDLLYYSWPEIENFEDVDRMFRSCDSTFGFGPGSEDDLGWLSSSDVIEGSGDGLTSGFKFPCPASNALGSTSASHETSKPKETNISTDNSGIENQSLGYNSSSWSSEKNESVNLSHLSFLNGSSNLQCKLAPDKKAEVHGGGVQVEIVSNNQPRINNNVVDSMQKKHSKHQNLSKGKIKCGYLENGDALNYTDSHPEEQKLPSGIASTQVNFTSAGVLQQKQAQDPDFGYLGGSFSYMHSDYGHSNGSALHPTLPILKYESNGLVSLSPKDSYASNQVQSMEGSPDPSFQVAAMTRNEKVEKLFHRSGVKVENNRDFEGVGIRIPTELGSSVVQECSSTNSGLDEISEEAASFHQLQRVMEQLDIQTKLCIRDSLYRLARSAEQRHRHANLNIVSGDDGGTSEPLVTEGTNKCTGYVDIETDTNPIDRSIAHLLFHRPSDSAVTPARDSSTLKSPSMIHGSLSSAPVMSDNLISHGEIAFQTDGEAADH

SEQ ID NO: 5026 - protein, 189 aa, Capsicum annuum
MSDLQLYELDDISWDEVCPNDDHIVPHPSSRRANEPLSQNDSRKKPRHEVIVLTGNGGDQSTVKYANQQKEQVLSNRSPQMLEKDSWADAPDGAFSSPREKAIVGDVSSLPSENTRTSNRCIKSNNLESIESESSPNGCTLDDKNAAVGENSYNYPLGPISQADDDLSFLDIVVRIKTLMISYIITGLR

SEQ ID NO: 5027 - protein, 88 aa, Solanum phureja
MKMKNLSLLFLTHLTLFFICVCSQNIAQTQFVYKWSETYCNKDTPVGCTQIPPLKFTLNGFWGINSLSSYMKLISERSTEKLLLIDRF

SEQ ID NO: 5028 - protein, 257 aa, Solanum phureja
MKMKNLSLLFLTHLTLFFICVCSQNIVQTQFVYKWSETYCNKDTPVGCTQIPPLKFTLNGFWGTDSNGNIQQGCRDPETRDWNKVFDKAMENQLKSFWPSLTKQDPKDMWKEAWNTYGTCTIENFKTPTKYFNRASRLANEIGDLLQSHLINSNGIVPCDSATYNNVEILNSIKQVSKNKDVSFTCKDINTTHAYLNQVTFCYINDAKHFVNCPTSVTNKRCRVQNIIVPRPSPPKVRAFFDITTKEIFSDNKYSND

SEQ ID NO: 5029 - protein, 434 aa, Solanum phureja
MAESQLVHPPLFTYISMLALLTLVPPFVILMWYTNVHADGSVLQTFNYLKENGLQGLIDIWPRPTAIAGKIIICYALFEATLQLLLPGKRVQGPISPTGHRPVYKANGMAAYTVTLITYLSLWWFGIFNPTVVYDHLGEILSTLNFGSLIFCLFLYIKGHVAPSSTDHGSSGNIIVDYYWGMELYPRIGKHFDIKVFTNCRFGMISWGLLPITYCIKQYEEYGSLSDSMLIHTIITLVYVTKFFWWEAGYWNTMDIAHDRAGFYICWGCLVFLPCMYTSPGMYLVKHPVNLGPQLAISILVAGILCVYINYDCDRQRQEFRRTNGKALVWGKAPSKIVASYTTTTGETKSSLLLTSGWWGLSRHFHYVPEILASFFWSVPALFNHIMPYFYVIYLTGLLLDRAKRDDERCKSKYGKYWKKYCEKVPYRVVPGIY

SEQ ID NO: 5030 - protein, 434 aa, Solanum tuberosum
MAESQLVHPPLFTYISMLALLTLVPPFVILMWYTNVHADGSVLQTFNYLKENGLQGLIDIWPRPTAIAGKIIICYALFEATLQLLLPGKRVQGPISPTGHRPVYKANGMAAYTVTLITYLSLWWFGIFNPTVVYDHLGEILSTLNFGSLIFCLFLYIKGHVAPSSTDHGSSGNIIVDYYWGMELYPRIGKHFDIKVFTNCRFGMISWGLLPITYCIKQYEEYGSLSDSMLIHTIITLVYVTKFFWWEAGYWNTMDIAHDRAGFYICWGCLVFLPCMYTSPGMYLVKHPVNLGPQLAISILVAGILCVYINYDCDRQRQEFRRTNGKALVWGKAPSKIVASYTTTTGETKSSLLLTSGWWGLSRHFHYVPEILASFFWSVPALFNHIMPYFYVIYLTGLLLDRAKRDDERCKSKYGKYWKKYCEKVPYRVIPGIY

SEQ ID NO: 5031 - protein, 434 aa, Solanum melongena
MAESQLVHPPWFTYISMLTLLTIVPPFVILMWYTNVHADGSVLQTYNYLKDNGLQGLIDIWPRPTAIAGKIIICYALFEAALQLLLPGKRVQGPISPTGHIPVYKANGMLAYTVTLVTYLSLWWFGIFNPTIVYDHLGEILSTLNFGSLVFCLFLYIKGHVAPSSTDHGSSGNIIVDFYWGMELYPRIGKHFDIKVFTNCRFGMISWGVLPITYCIKQYEEYGHLSDSMLVHSIITLVYVTKFFWWEAGYWNTMDIAHDRAGFYICWGCLVFLPCIYTSPGMYLVKHPVNLGHELAIAILVAGILCVYINYDCDRQRQEFRRTNGKALVWGKAPSKIVASYTTTTGETKTSLLLTSGWWGLARHFHYVPEILASFFWSVPALFNHFIPYFYVIYLTVLLFDRAKRDDERCKSKYGKYWKKYCEKVPYRVIPGIY

SEQ ID NO: 5032 - protein, 434 aa, Solanum lycopersicum
MVENKLVHSPLITYGSMLSLLSFTPPFVILMWYTNVHADGSILKTFNHLRENGLQGLIDIWPKPTAIAGKLIICYALFEAALQLLLPGKTVEGPISPTGHRPVYKANGMAAYAVTLITYISLWWFGIFNPAIVYDHLGEIFSTLIFGSLVFCVLLYIKGHVAPSSTDSGSSGNIIVDFYWGMELYPRIGKHFDIKVFTNCRFGMMSWAVLAVTYCIKQHEEYGRVSDSMLVNTILMLVYVTKFFWWEAGYWNTMDIAHDRAGFYICWGCLVWVPSIYTSPGMYLVKQPVNLGLQLSLYILVAGLLCIYINYDCDRQRQEFRRTNGKCTVWGKTPSKIVAAYTTTSGEKKTSLLLTSGWWGLARHFHYVPEILAAFFWSVPALFNHFIPYFYVIFLIILLLDRAKRDDDRCKAKYGKYWKLYCEKVPYRVIPGIY

SEQ ID NO: 5033 - protein, 434 aa, Vitis vinifera
MAEAKTVHSPALTYFSMISLLTLCPPFVILLWYTMVHSDGSVLQTWDYLKQHGVQGFIDIWPRPTAIAWKLIACYAAFEAALQLFLPGKTVEGPISPCGNRPVYKANGMQAYAVTLITYLSLWWFGIFNPAIVYDHLGEIYSALIFGSLIFCIFLYIKGHVAPSSTDSGSSGNIIIDFYWGMELYPRIGKNFDIKVFTNCRFGMMSWAVLAVTYCIKQYEENGKVADSMLVNTILMLVYVTKFFWWEAGYWNTMDIAHDRAGFYICWGCLVWVPSIYTSPGMYLVNHPVNLGTQLAIYILAAGITCIYINYDCDRQRQEFRRTNGKCLVWGKAPSKIVASYTTTSGETKSSLLLTSGWWGLSRHFHYVPEILAAFFWTVPALFGHFLPYFYVLFLTILLFDRAKRDDDRCRSKYGKYWKKYCEKVRYRIIPGIY

SEQ ID NO: 5034 - protein, 435 aa, Mimulus guttatus
MGSESKMVHSPMITYASMLSLLSLCPPFVILLWYTMVHADGSVLQTWDYLRQHGVQGFINFWPKPTATAWKIIACYGAFEAALQLLLPGKRVEGPISPTGNRPVYKANGVLAYAVTLITYLGLWWFGIFNPTIVYDHLGEIFSALIFGSLVFCVFLYIKGLVAPSSTDSGSSGNIIIDFYWGMELYPRIGKNFDIKVFTNCRFGMMSWAVLAVTYCIKQYETYGTVSDSMLVNTILMLVYVTKFFWWEAGYWSTMDIAHDRAGFYICWGCLVWVPSVYTSPGMYLVNHPVTLGVQLALYILVAGVLCIYINYDCDRQRQEFRRTNGKGLVWGKAPSKIVASYTTTTGETKSSILLTSGWWGLARHFHYVPEILAAFFWTLPALFNHFLPYFYVVFLTILLLDRAKRDDDRCKSKYGKYWKLYCEKVPYRVVPGIY

SEQ ID NO: 5035 - protein, 434 aa, Prunus persica
MGETNTVHSPLVTYASMLSLLCLCPPFVILLWYTMVHADGSISQTWDYLKHHGVQGFIEIWPRPTATAWKIIACYGAFEAALQLLLPGKRVEGPISPTGNRPVYKANGMAAYFVTLATHLGLWWFGIFNPTIVYDHLGEIFSALIFGSFIFCILLYIKGHLAPSSTDSGSSGNAIIDFYWGMELYPRIGKNFDIKVFTNCRFGMMSWAVLAVTYCIKQYEVNGTVADSMLVNTILMLVYVTKFFWWEAGYWNTMDIAHDRAGFYICWGCLVWVPSIYTSPGMYLVNHPVNLGTQLALFILVAGILCIYINYDCDRQRQEFRRTNGKCLVWGKAPSKIVASYTTTSGETKTSLLLTSGWWGLSRHFHYVPEISAAFFWTVPALFNHFLPYFYVVFLTILLLDRAKRDDDRCRSKYGKYWKLYCQKVSYRVIPGIY

SEQ ID NO: 5036 - protein, 400 aa, Castanea mollissima
MVHADGSVSQTFDYLKQHGLQGLIDIWPRPTATAWKIIACYAAFEAALQLLLPGKRVEGPISPMGNRPVYKANGVAAYVVTLVTYLGLWWFGIFNPTVVYDHLGEIFSALIFGSFVFCIFLYIKGRVAPSSTDSGSCGNVIIDFYWGMELYPRIGKHFDIKVFTNCRFGMMSWAVLAVTYCIKQYEVNGRVADSMLVNTVLMLVYVSKFFWWEAGYWSTMDIAHDRAGFYICWGCLVWVPSIYTSPGMYLVNHPVNLGTQLALYILVAGILCIYINYDCDRQRQEFRRTNGKCLVWGKAPTKIVASYTTTSGETKNSLLLTSGWWGLSRHFHYVPEILSAFFWTVPALFNHFLPFFYVIFLTILLFDRAKRDDDRCRSKYGKYWKVFCEKVPYRIIPGIY

SEQ ID NO: 5037 - protein, 434 aa, Populus trichocarpa
MAETKTVHSPLVTYFSMLSLLTLCPPFVILLWYTMVHADGSVCQTWDYLKQHGLQGFINIWPRPTAIAWKIIACYAAFEAALQLLLPGKKVEGPISPEGNRPVYKANGVAAYVVTLVTYLSLWWFGIFNPSIVYDNLGEIFSALIFGSLVFCVFLYIKGHLAPSSTDSGSSGNMIIDFYWGLELYPRIGKNFDIKVFTNCRFGMMSWAVLALTYCIKQYEQNGKVADSMLVNTILMLVYVTKFFWWEAGYWNTMDIAHDRAGFYICWGCLVWVPSVYTSPGMYLVNHPVNLGLQLALYILAAGILSIYVNYDCDRQRQEFRRTNGKCLVWGRAPSKIVASYTTTSGQTKISLLLTSGWWGLSRHFHYVPEILAAFFWTVPALFNHFLPYFYVIFLTILLFDRAKRDDDRCRSKYGKYWKLYCEKVRYRIVPGIY

SEQ ID NO: 5038 - protein, 330 aa, Solanum phureja
MNFLRRVISPGSRSQVSQFANRSFKITQNHYGSIAQPTSSSLVHGIHQFHCPDVVGILAKLSDCIASREGNILSADIFVPDDNHVFYSRSEFLFDPAKWPREQMDADFSNLAKKFNAMKSVVRVPDSDPKYNISILASKQEHCLVDLLHGWQDGRFPIHITSVISNHERGPNTHVIRFLERHGIPYYYLPTTKENKREEEILDIVGDTDFLVLARYMQVLSGDFLKSYKKDIINIHHGLLPSFKGSNPSKQAFDAGVKLIGATTHFVSEELDSGPIIEQLVERVSHRDNLRTFIQKSEDVEKRCLAKAIKSYCELRIFPYEANKTVVFRS

SEQ ID NO: 5039 - protein, 330 aa, Solanum tuberosum
MNFLRRVISPGSRSQVSQFANRSFKITQNHYGSIAQPTSSSLIHGIHQFHCPDVVGILAKLSDCIASREGNILSADIFVPDDNHVFYSRSEFLFDPAKWPREQMDADFSNLSKKFNAMKSVVRVPDIDPKYKISILASKQEHCLVDLLHGWQDGRFPIHITSVISNHERGPNTHVIRFLERHGIPYYYLPTTKENKREEEILDIVGDTDFLVLARYMQVLSGDFLKSYKKDIINIHHGLLPSFKGSNPSKQAFDAGVKLIGATTHFVSEELDSGPIIEQLVERVSHRDNLRTFIQKSEDVEKRCLAKAIKSYCELRIFPYEANKTVVFRS

SEQ ID NO: 5040 - protein, 330 aa, Solanum tuberosum
MNFLRRVISPGSRSQVSQFANRSFKITQNHYGSIAQPTSSSLIHGIHQFHCPDVVGILAKLSDCIASREGNILSADIFVPDDNHVFYSRSEFLFDPAKWPREQMDADFSNLSKKFNAMKSVVRVPDIDPKYKISILASKQEHCLVDLLHGWQDGRFPIHITSVISNHERGPNTHVIRFLERHGIPYYYLPTTKENKREEEILDIVGDTDFLVLARYMQVLSGDFLKSYKKDIINIHHGLLPSFKGSNPSKQAFDAGVKLIGATTHFVSEELNSGPIIEQLVERVSHRDNLRTFIQKSEDVEKRCLAKAIKSYCELRIFPYEANKTVVFRS

SEQ ID NO: 5041 - protein, 330 aa, Solanum melongena
MNFLRRVISPSSRSQISEFANRSFKTSQNHYGSIAQSTSSSLVHGIHQFHCPDVVGILARLSDCIASREGNILSADIFVPDDKHVFYSRSEFLFDPAKWPREQMDADFSMIAKKFNAMKSVVRVPDIDPKYKIAILASKQEHCLVDLLHGWQDGRLPIDITSVISNHERGPNTHVIRFLERHGIPYYYLPTTKENKREGEILEIVKDTDFLVLARYMQVLSGDFLNSYKKDIINIHHGLLPSFKGSNPSKQAFDAGVKLIGATTHFVSEELDSGPIIEQLVERVSHRDNLRTFIQKSEDVEKRCLAKAIKSYCELRIFPYEANKTVVFRS

SEQ ID NO: 5042 - protein, 137 aa, Solanum phureja
MKTFKCNFYILFLLILPLIFGSRCLARVQVHIINRLPDGMPMTLHCQSHDNDLGQLRLTGGDEANWTFSVNFWGTTMFYCDAQWDNSSMTYRFITYDASRDARRCQTECWWMISEEETLYGYNQESEYWELFPFTSA

SEQ ID NO: 5043 - protein, 139 aa, Solanum tuberosum
QKMKTFKCNFYTLFLLILPLIFGSRCLARVQVHIINRLPDGMPMTLHCQSHDNDLGQLRLTGGDEANWTFSVNFWGTTMFYCDAQWDNSSMTYRFITYDASRDARRCQTECWWMISEEETLYGYNQESEYWELFPFTSA

SEQ ID NO: 5044 - protein, 309 aa, Solanum tuberosum
MDGRGGCCIARYAGGAYDMSKVDRIMLKFRPIAPKPAAAGSSVSGTTTPPQKTEVPVRTGRWKRRYVKENNKNSNNSKRSNSGSSPSGRKRKAPSPEENESSGKTVSGGETVVTLPLLSESPERKDRSVDVVKKNAPIWLSFGGNQGNNNGQLQGYGGVMFPQPVQVVGSWVKVESVTDAWVEGYGLGRTDEEKLINLERDSCPGFISDGLNRVRWANKAYKAMVGEGTGEVVVWLVMKDDVRLPDNKSTAAFTCRVRVVRCGKEKNSLILPCDVWRMDGGGFAWRLDTEAALSLGRYVIKVISTPPEG

SEQ ID NO: 5045 - protein, 309 aa, Solanum phureja
MDGRGGCCIARYAGGAYDMSKVDRIMLKFRPIAPKPAAAGSSVSGTTTPPQKTEVPVRTGRWKRRYVKENNKNSNNSKRSNSGSSPSGRKRKAPSPEENESSGKTVSGGETVVTLPLLSESPERKDRSVDVVKKNSPIWLSFGGNQENNNGQSQGYGGVMFPQPVRVVGSWVKVESVTDAWVEGYGLGRTDEEKLINLERDSCPGFISDGLNRVRWANKAYKAMVGEGAGEVVVWLVMKDDVRLPDNKSTAAFTCRVRVVRCGKEKNSLILPCDVWRMDGGGFAWRLDTEAALSLGRYVIKVISTPPEG

SEQ ID NO: 5046 - protein, 83 aa, Solanum phureja
MSSSRRAWIVAASVGAVEALKDQVGLCRWDYPLKCLAQHTKNNIRSYSQAKKLSSSLIAKSEKTEQSEESLRKVMYLSCWGPN

SEQ ID NO: 5047 - protein, 83 aa, Solanum lycopersicum
MSSSRRAWIVAASVGAVEALKDQVGLCRWDYPLKCLAQHTKNNMRSYSQAKKLSSSLIAKSENAEQSEESLRKVMYLSCWGPN

SEQ ID NO: 5048 - protein, 83 aa, Solanum phureja
MSSSRRAWIVAASVGAVEALKDQVGLCRWDYPLRCLAQHTKNNMRSYSQAKKLSSSLIAKSEKAEQSEESLRKVMYLSCWGPN

SEQ ID NO: 5049 - protein, 83 aa, Solanum tuberosum
MSLSRRAWIVAASVGAGEGLKDQVGLCKWDYPLKCLAQHTKNNMRSYSQAKKLSSSLIAKSEKTEQSEESLRKVMYLSCWGPN

SEQ ID NO: 5050 - protein, 83 aa, Solanum phureja
MSLSRRAWIVAASVGAVEALKDQVGLCRWNYPLKSLAQHTKNNMRSYSQAKKLSSSLIAKNEKAEQSEESLRKVMYLSCWGPN

SEQ ID NO: 5051 - protein, 83 aa, Solanum phureja
MSLSRRAWIVAASVGAVEALKDQVGLCRWNYPLKSLAQHTKNNMRSYAQAKKLSSSLIAKNEKAEQSEESLRKVMYLSCWGPN

SEQ ID NO: 5052 - protein, 82 aa, Solanum phureja
MSSSRRAWIVAASVGAMEALKDQVGLCRWDYPLRCLAKHTKNNMRSYSQAKKLSSLIAKKEKAEQYEESLRKVMYLSCWGPN

SEQ ID NO: 5053 - protein, 81 aa, Capsicum annuum
MSSSRRAWIVAASIGAVEALKDQVGLCRWNYPLRCVAQHTKNNIRSYSQAKKLSSSLIANKAEQSEESLRKVMYLSCWGPN

SEQ ID NO: 5054 - protein, 83 aa, Solanum lycopersicum
MSSSRRAWIVAASVGAVEALKDQVGLCRWNYPLRSLAQHTKNNVRSYSQAKKLSSSITTKSEKMEKSEESLRKVMYLSCWGPN

SEQ ID NO: 5055 - protein, 81 aa, Capsicum annuum
MSLSRRAWIVAASVGAVEALKDQVGLCRWNYPLRCVAQHTKNNIRSYSQAKKLSSSLIANKAEQSEESLRTVMYLSCWGPN

SEQ ID NO: 5056 - protein, 84 aa, Solanum melongena
MSSSRRAWIVAASVGAVEALKDRVGLCRWDYPLRRLAQHTKNNIRSFPQAKRLSSSLIVAKRDKAEQSEESLRKVMYLSCWGPN

SEQ ID NO: 5057 - protein, 85 aa, Petunia hybrida
MSSSRRAWIVAASVGAVEALKDQGFARWNYPLKCLAQHTKNNMRSYSQAKKLSSSSSSLISRSDKAKQSEESLRNVMYLSCWGPN

SEQ ID NO: 5058 - protein, 85 aa, Petunia hybrida
MSSSRRAWIVAASVGAVEALKDQGFARWNYPLRCLAQHTKNNMRSYSQAKKLSSSSSSLISRSDKAKQSEESLRNVMYLSCWGPN

SEQ ID NO: 5059 - protein, 86 aa, Nicotiana tabacum
MSSSRRAWIVAASVGAVEALKDQGFCRWNYPLTSFAQHAKNNMRSYSQVKKLSSTSSSSLIARSEKAKQSEESLRKVMYLSCWGPN

SEQ ID NO: 5060 - protein, 304 aa, Solanum phureja
MWRNSCNLLKRTVSSVARTNTINYGVNPFLGVDYKFGCYCGPTRMVGGYYFSSGSNGGGENKNGDSITHEEAKRLMRLVNVEELKWKLGMKNTEVIGYMDLLKACQNMGVAKTHDEAVGFARVLDEAGVILLFRDKVYLHPDKVVDEIRKAVPLALLPEDDPTIEELKILQEKKDKIDELAHRYVRRVLWAGLGAGLLQVGLFFRLTFWEFSWDVMEPIAFFTTSAGIVIGYAYFLVTSRDPSYQDVLKRLFISRQRKLIKKHDFDIQRFVELQKKIKLPVNSQSSIKHRLGMELEPEDLLHRH

SEQ ID NO: 5061 - protein, 278 aa, Solanum tuberosum
GVDYKFGCYCGPTRMVGGYYFSSGSNGGGENKNGNGNGDSITHEEAKRLMRLVNVEELKWKLGMKNTEVIGYMDLLKACQNMGVAKTHDEAVGFARVLDEAGVILLFRDKVYLHPDKVVDEIRKAVPLALLPEDDPTIEELKILQEKKDKIDELAHRYVRRVLWAGLGAGLLQVGLFFRLTFWEFSWDVMEPIAFFTTSAGIVIGYAYFLVTSRDPSYQDVLKRLFLSRQRKLIKKHDFDIQRFVELQKKIKLPVNSQSSIKHRLGMELEPEDLLHRH

SEQ ID NO: 5062 - protein, 496 aa, Arabidopsis lyrata
MSLWYIIVAFVFFSSIIIVRNTRTTKTNLPPGPPRLPIIGNLHQLGSKPHRSMFKLSEKYGSLMSLKFGNVSTVVASTPETVKEVLKTFDVECCSRPYMTYPARFTYNLKDLGFSPYSTYWREVRKMTVVELYTAKRVKSFQHTRKEEVASLVDFIKQAASLEKSVNLNNKLMKLAGSVICRVAFGINLKGSKLENTYEEVIQGTMEVVGSFAAADYFPVIGTIIDRITGLHSKCEKIFKAMDAFFDQSIKHHLEDESIKDDITALLLKMERGETGLGEFQLTRDHTKGILFNILNAGIDTSAQVMTWVMTYLIANPRVLKKVQAEVREVIKNKDEIIEEVIERLEYLKMVIRETFRVLPLVPLLIPREASKNLKIGGYDIPKKTWIHVNIWAIHRNPNVWKDPEAFIPERFMDSEIDYKGLNFELLPFGSGRRMCPGIGMGMALVHLTLINLLYRFDWKLPEGMKVEDVDLEESYGLVCPKKVPLQLIPVLTQWT

SEQ ID NO: 5063 - protein, 496 aa, Arabidopsis thaliana
MSLWYIIVAFVFFSSMIIVRIIRKTKKNLPPGPPRLPIIGNLHQLGSKPHRSMFKLSETYGPLMSLKFGSVSTVVASTPETVKEVLKTFDVECCSRPNMTYPARVTYNLKDLCFSPYSKYWREVRKMTVVELYTAKRVQSFQHTRKEEVAALVDFIKQAASLEKPVNLNKKLMKLSGSVICRVAFGINLQGSKLENTYEEVIQGTVELVGSFAAADYFPVVGRIIDRITGLHSKCEKLFKAMDAFFDQSIKHHLEDEIIKDDIIDLLLKMERGETTLGEFQLTRDHTKGILANILNAGIDTSAQVMTWVMTYLISNPRVLKKAQAEVREVIKHKDDIIEEDIERLQYLKMVIKETFRINPLVPLLIPREASKDVKIGGYNIPKKTWIHVNIWAIHRNPNVWKDPEAFIPERFMDSQIDYKGLNFELLPFGSGRRICPGIGMGMALVHLTLINLLYRFDWKLPEGMKVADVDLEESYGLVCPKKIPLQLIPVLTQWT

SEQ ID NO: 5064 - protein, 496 aa, Arabidopsis thaliana
MSLWYIIVVFVFFASIFIAKNTRKTKKNLPPGPPRLPIIGNLHQLGSKPHRSMFKLSEKYGPLVYLKLGKVPSVVASTPETVKDVLKTFDKDCCSRAFLTYPARISYNLKDLAFAPYSKYWKAVRKMTVVELYTAKRVKSFRNIREEEVASFVEFIKHSASLEEIVNLNQTLVKLSGSVICRVGFGINLEGSKLENTYEEVIHGTMEVLGSFAASDYFPVIGGIIDRITGLHNKCEKVFKGTDSFFDHCIKHHLEDGGSKDDIVDLLLKVERGEIGLGEFQFTRNHTKGILLDILLAGVDTSGHTITWVMTHLIKNPRVMKKAQAEVREVIKNKDNITEEDIEGLEYLKMVVKETLRINPLVPLLTPREASKDVKIGGYNIPKKTWIHVNIWAIHRNPNVWKDPEAFIPERFMDNQIDYKGLNFELLPFGSGRRICPGIGMGMALIHLTLINLLYRFDWKLPEGMEVEDVDLEESYGLVCPKKVPLELIPVLTQWT

SEQ ID NO: 5065 - protein, 496 aa, Arabidopsis thaliana
MIWWFIVGASFFFAFILIAKDTRTTKKNLPPGPPRLPIIGNLHQLGSKPQRSLFKLSEKYGSLMSLKFGNVSAVVASTPETVKDVLKTFDAECCSRPYMTYPARVTYNFNDLAFSPYSKYWREVRKMTVIELYTAKRVKSFQNVRQEEVASFVDFIKQHASLEKTVNMKQKLVKLSGSVICKVGFGISLEWSKLANTYEEVIQGTMEVVGRFAAADYFPIIGRIIDRITGLHSKCEKVFKEMDSFFDQSIKHHLEDTNIKDDIIGLLLKMEKGETGLGEFQLTRNHTKGILLNVLIAGVDTSGHTVTWVMTHLIKNPRVMKKAQAEVREVIKNKDDITEEDIERLEYLKMVIKETLRINPLVPLLIPREASKYIKIGGYDIPKKTWIYVNIWAVQRNPNVWKDPEVFIPERFMHSEIDYKGVDFELLPFGSGRRMCPGMGLGMALVHLTLINLLYRFDWKLPEGMNIEDVDLEESYGLVCPKKVPLQLIPVLTQWT

SEQ ID NO: 5066 - protein, 289 aa, Brassica rapa
MASRPCDSCRSAAATLFCRADAAFLCGECDGKIHTANKLASRHERVLLCQVCEQSPAHVTCKADAAALCVTCDRDIHSANPLSRRHERVPVTPFYDAPSNADVSMEAASWLLRNPSVKEGGVEIPNLFADLDYSGVDPKMEASENSSGNDGVVPVQTRALFLSEDYFNFDISASKTTFPHGFSCINQTVSSTSLDVPLVPEGGAVAEMSRTTAAPALQLSPAEREARVLRYREKRKNRKFEKTIRYASRKAYAEVRPRIKGRFAKRTDSRVNDGGEVGVYGGFGVVPSF

SEQ ID NO: 5067 - protein, 312 aa, Brassica napus
MASRPCDSCRSAAATLFCRADAAFLCGECDGKIHSANKLASRHERVWLCQVCEQSPAHVTCKADAAALCVTCDRDIHSANPLSRRHERVPVTPFYDAPSAQGGSSSAAKSASSSANFLNTEDADVSMEAASWLLPNSSVKEGVVEIPNLFADLDYSAVVDPKMEASENSSGNDGVVPVQTKALFLSEDYFSFDISASKTTFPHGFSCINQTVSSTSLDVPLVPEGGAVAEISRTAATPAVQLSPAEREARVLRYREKRKNRKFEKTIRYASRKAYAEVRPRIKGRFAKRTDSRVNDGGDGGVYGGFGVVPSF

SEQ ID NO: 5068 - protein, 216 aa, Brassica oleracea
MASRPCDSCRSAAATLLCRADAAFLCGECDGKIHSANKLASRHERVWLCQVCEQSPAHVTCKADAAALCVTCDRDIHSANPLSRRHERVPVTPFYDAPSAQGGSSSAAKSASSSANFLNTEDADVSMEAASWLLPNSSVKEGVVEIPNLFADLDTRRLLIRRWRRRRIAPATTESFLFRPKLCFSAKITSASTSQLPKQHSHTDSAALIKLFRQHP

SEQ ID NO: 5069 - protein, 308 aa, Raphanus sativus
MASRLCDSCRSAAATLYCRADAAFLCGECDGKIHTANKLASRHERVLLCQICEQAPAHVTCEADAAALCVTCDRDIHSANPLSRRHERVSVTPFYDAPAQGGSPATTKSAASSNLFGEDADVSMEAVSWLLPNPSVKEGVVVEIPNLFADLDYSAVDPKMEASENSSGNDGVVPVQTKALFLNEDYFNFDVSASKTTFPHGYSCINQTVSSTSLEVPLVPEGGAVTTTTTATPAVQLSPAEREARVLRYREKRKNRKFEKTIRYASRKAYAEVRPRIKGRFAKRTDSRVNDGGGGVGVYGGFGVVPSF

SEQ ID NO: 5070 - protein, 313 aa, Thellungiella halophila
MSSSRLCDSCKSAAATLFCRADAAFLCGECDGKIHSANKLASRHERVWLCEVCEQAPAHVTCKADAAALCVTCDRDIHSANPLSRRHERVPVTPFYDAAPGGGSAKSASSVNFVDEDADVSVEAASWLFPNPSIKYGGGEIPNLFSDLDYSAVDPKMEASENSSGNDGVVPVQNKLFLNEDYFNFDISTSKTFTQGPSCINQTVSSASLDVALVPEGGGMTEISNTTTTTTATPAVQLSPAEREARVLRYREKRKNRKFEKTIRYASRKAYEGEAEDQRTFCEANGFEKQRRRRRRNLRRIRRRPKFLSLHFR

SEQ ID NO: 5071 - protein, 241 aa, Brassica napus
MCGGAIISDFAPNVTKAKGRKLTAEELWSELDASAADDFWGFHSTSKTQSTNQQVTLKEEAAEKEKEPVTEKRRKRKNVYRGIRKRPWGKWASEIRDPRKGARVWLGTFNTAEEAAMAYDVAAKRIRGDKAKLNFPDLLHHPPRSPATPLASSPVSEVQPPAKKHCVVSQSELTQPSFPVECSGFGSGDEFQLDYDLKQQISSLESFLELDGDTVEQPSQLDESVSEVDMWMIDDVIASYQ

SEQ ID NO: 5072 - protein, 241 aa, Brassica rapa
  misc_feature (81)..(81): Xaa can be any naturally occurring amino acid
MCGGAIISDFAPNVTKAKGRKLTAEELWSELDASAADDFWGFHSTSKTQSTNQQVTLKEEAAEKEKEPVTEKRRKRKNVYXGIRKRPWGKWASEIRDPRKGARVWLGTFNTAEEAAMAYDVAAKRIRGDKAKLNFPDLLHHPPRSPATPLASSPVSEVQPPAKKHCVVSQSELTQPSFPVECSGFGSGDEFQLDYDLKQQISSLESFLELDGDTVEQPSRLDESVSEVDMWMIDDVIASYQ

SEQ ID NO: 5073 - protein, 237 aa, Brassica juncea
MCGGAIISDFAPIVTKAKGRKLTAEELWSELDASAADEFWGFHSTSKTQSTNQQEEAAEKEKEPATEKRRKRKNVYRGIRKRPWGKWASEIRDPRKGARVWLGTFNTAEEAAMAYDVAAKRIRGDKAKLNFPDLLHHPPRSPATPLASSPVSEVQPPAKKHCVVSQSELTQPSFPVECSGFGSGDEFQLDYDLKQQISSLESFLELDGDTVEQPSQLDESVSEVDMWMIDDVIASYQ

SEQ ID NO: 5074 - protein, 465 aa, Brassica napus
MAASGTVASFRTSVSSSPQLTHLRSPSKALKFTPLPSSRARPSFSVSCTIAKDPPVLMSAGSDPSLWQRPDSFGRFGKFGGKYVPETLMHALSELETAFHSLATDDDFQRELAGILKDYVGRESPLYFAERLTEHYRRENGEGPLIYLKREDLNHTGAHKINNAVAQALLAKRLGKKRIIAETGAGQHGVATATVCARFGLECIIYMGAQDMERQALNVFRMRLLGAEVRAVHSGTATLKDATSEAIRDWVTNVETTHYILGSVAGPHPYPMMVRDFHAVIGKETRRQALEKWGGKPDVLVACVGGGSNAMGLFHEFVNDTEVRLIGVEAAGFGVDSGKHAATLTKGDVGVLHGAMSYLLQDDDGQIIEPHSISAGLDYPGVGPEHSFLKDMGRAEYFSVTDEEALEAFKRVSRLEGIIPALETSHALAHLEKLCPTLPDGSRVVLNFSGRGDKDVQTVAKYLEV

SEQ ID NO: 5075 - protein, 465 aa, Brassica napus
MAASGTVASFRTSVSSSPQLTHLRSPSKALKFTPLPSSRARPSFSVSCTIAKDPPVLMSAGSDPSLWQRPDSFGRFGKFGGKYVPETLMHALSELETAFHSLATDDDFQRELAGILKDYVGRESPLYFAERLTEHYRRENGEGPLIYLKREDLNHTGAHKINNAVAQALLAKRLGKKRIIAETGAGQHGVATATVCARFGLECIIYMGAQDMERQALNVFRMRLLGAEVRAVHSGTATLKDATSEAIRDWVTNVETTHYILGSVAGPHPYPMMVRDFHAVIGKETRRQALEKWGGKPDVLVACVGGGSNAMGLFHEFVDDTEIRLIGVEAAGFGVDSGKHAATLTKGDVGVLHGAMSYLLQDDDGQIIEPHSISAGLDYPGVGPEHSFLKDMGRAEYFSVTDEEALEAFKRVSRLEGIIPALETSHALAHLEKLCPTLPDGSRVVLNFSGRGDKDVQTVAKYLEV

SEQ ID NO: 5076 - protein, 465 aa, Brassica napus
MAASGTVASFRTSVSSSPQLTHLRSPSKALKFTPLPSSRSRPSFSVSCTIAKDPPVLMSAGSDPTLWQRPDSFGRFGKFGGKYVPETLMHALSELETAFHSLATDDDFQRELAGILKDYVGRESPLYFAERLTEHYRRENGEGPLIYLKREDLNHTGAHKINNAVAQALLAKRLGKKRIIAETGAGQHGVATATVCARFGLECIIYMGAQDMERQALNVFRMRLLGAEVRAVHSGTATLKDATSEAIRDWVTNVETTHYILGSVAGPHPYPMMVRDFHAVIGKETRRQALEKWGGKPDVLVACVGGGSNAMGLFHEFVDDTEIRLIGVEAAGFGVDSGKHAATLTKGDVGVLHGAMSYLLQDDDGQIIEPHSISAGLDYPGVGPEHSFLKDMGRAEYFSVTDEEALEAFKRVSRLEGIIPALETSHALAHLEKLCPTLPDGSRVVLNFSGRGDKDVQTVAKYLEV

SEQ ID NO: 5077 - protein, 472 aa, Cucumis sativus
MVASTALNCKIPTFSPSSSHSNNKISSSTSHFPVRFRRVSSNPSPVFRSNAVSCTLTREPSLAMEDKVHDSSLQQRPDSFGRFGRFGGKYVPETLMHALTELETAFYSLAGDQDFQKELDGILRDYVGRESPLYFAERLTEHYRRSNGEGPHIFLKREDLNHTGAHKINNAVAQALLAKRLGKKRIIAETGAGQHGVATATVCARFGLECIIYMGAQDMERQALNVFRMQLLGAEVRPVHSGTATLKDATSEAIRDWVTNVETTHYILGSVAGPHPYPMMVRDFHAVIGKETRKQALEKWGGKPDVLVACVGGGSNAMGLFHEFVNDKDVRLVGVEAAGFGLDSGKHAATLTKGEVGVLHGAMSYLLQDDDGQIIEPHSISAGLDYPGVGPEHSYLKDLGRAEYHSVTDDEALEAFKRLARLEGIIPALETSHALAYLEKLCPTLPDGTKVVLNCSGRGDKDVQTAIKYLQV

SEQ ID NO: 5078 - protein, 465 aa, Helianthus annuus
MAFSSSNITYRATITKPSSSPYPRSNPSQSSLTFTKASTFSPKSFSVSCVMTQQSTNSSAAAAEPALLRPDSLGRFGKFGGKYVPETLMYALSELESAFHALATDHEFQKELDGILKDYVGRESPLYFAERLTEHYKRPNGEGPEIYLKREDLNHTGAHKINNAVAQALLAKKLGKERIIAETGAGQHGVATATVCARFGLKCIIYMGAQDMERQALNVFRMKLLGAEVRAVHSGTATLKDATSEAIRDWVTNVETTHYILGSVAGPHPYPMMVREFHAVIGKETRKQALEKWGGKPDVLVACVGGGSNAMGLFHEFVDDKDVRLIGVEAAGFGLDSGKHAATLTKGEVGVLHGAMSYLLQDDDGQIIEPHSISAGLDYPGVGPEHSFLKDLGRAEYYSITDAEALEAFKRLSRLEGIIPALETSHALAYLEKLCPTLPNGTKVVLNCSGRGDKDVHTAIKHLQV

SEQ ID NO: 5079 - protein, 452 aa, Cucumis melo
SNNKISSSIPHFPVRFRRVSSNPSPLLRSNAVSCTLTREPSLAMEDKLHTLSLQQRPDSFGRFGRFGGKYVPETLMHALTELEAAFYSLAGDQDFQKELDGILRDYVGRESPLYFAERLTEHYRRSNGEGPHIFLKREDLNHTGAHKINNAVAQALLAKRLGKKRIIAETGAGQHGVATATVCARFGLECIIYMGAQDMERQALNVFRMRLLGAEVRPVHSGTATLKDATSEAIRDWVTNVETTHYILGSVAGPHPYPMMVRDFHAVIGKETRKQALEKWGGKPDVLVACVGGGSNAMGLFHEFVNDEDVRLVGVEAAGFGLDSGKHAATLTKGEVGVLHGAMSYLLQDDDGQIIEPHSISAGLDYPGVGPEHSYLKDLGRAEYHSVTDDEALEAFKRLSRLEGIIPALETSHALAYLEKLCPTLPDGTKVVLNCSGRGDKDVQTAIKYLQV

SEQ ID NO: 5080 - protein, 412 aa, Artemisia annua
MSAVHVNDEPAAVHERPDLFGRFGKYGGKYVPETLMFALTQLEAAFKALATDHQFQKELDGILKDYVGRESPLYFAERLTEHYKRPNGEGPEIYLKREDLNHTGAHKINNAVAQALLAKKLGKERIIAETGAGQHGVATATVCARFGLQCIIYMGAQDMERQALNVFRMRLLGAEVRAVHSGTATLKDATSEAIRDWVTNVETTHYILGSVAGPHPYPMMVREFHAVIGKETRKQALEKWGGKPDVLVACVGGGSNAMGLFHEFVDDKEVRLIGVEAAGHGLDSGKHAATLTLGEVGVLHGAMSYLLQDDDGQIIEPHSISAGLDYPGVGPEHSFLKDIGRAEYHSVTDEEALEAFKRLSRLEGIIPALETSHALAYLEKLCPTLPNGTKVVLNCSGRGDKDVHTAIKYLQL

SEQ ID NO: 5081 - protein, 456 aa, Solanum lycopersicum
MAFSSPSKIAPPLPKPHRFSSLSQSQIPFKFIKITSLPTKPPAIACVLTGKSMDATAVQRPDSFGRFGKFGGKYVPETLMHALDELETAFNSLATDQDFQKELDGILRDYVGRESPLYFAERLTEHYKRPDGEGPMIYLKREDLNHTGAHKINNAVAQALLAKRLGKKRIIAETGAGQHGVATATVCARFGLDCVIYMGAQDMERQALNVFRMRLLGAEVRAVHSGTATLKDATSEAIRDWVTNVETTHYILGSVAGPHPYPMMVREFHAVIGKETRKQSLEKWGGKPDVLVACVGGGSNAMGLFHEFVDDKDVRLIGVEAAGFGLDSSKHAATLTKGEVGVLHGAMSYLLQDEDGQIVEPHSISAGLDYPGVGPEHSFLKDLGRAEYYSITDEEALEAFKRLSRLEGIIPALETSHALAYLEKLCPTLANGTKVVLNCSGRGDKDVQTAIKYLKV

SEQ ID NO: 5082 - protein, 468 aa, Mimulus guttatus
MAFSASSSSSAVICRTQTDLPINLRSRSRSLLSPKLNRVGATFCRPIVCKMAATAVEKELDPAAAAAAPLQRPDSFGRFGKYGGKYVPETLMHALTELEAAFKLLATDDEFQKELDGILKDYVGRETPLYFAERLTEHYKRPDGKGPHIYLKREDLNHTGAHKINNAVAQALLAKRLGKKRIIAETGAGQHGVATATVCARFGLECIIYMGAQDMERQALNVFRMRLLGAEVRAVHSGTATLKDATSEAIRDWVTNVESTHYILGSVAGPHPYPMMVREFHAVIGKETRKQALEKWGGTPDVLVACVGGGSNAMGLFHEFVDDKDVRLIGVEAAGFGLDSGKHAATLTKGEVGVLHGAMSYLLQDEDGQIVEPHSISAGLDYPGVGPEHSFLKDIGRAEYYSITDDEALEAFKRLSKLEGIIPALETSHALAYLEKLCPTLADGTKVVLNCSGRGDKDVHTAIKYLKL

SEQ ID NO: 5083 - protein, 467 aa, Raphanus sativus
MAASSTVASFRTSVSSAPSPSSSRITHLRSPSKALKFTPLPSSRSRPSFSVSCTIAKDPPVLMSDPSLWQRPDSFGRFGKFGGKYVPETLMHALSELESAFHSLAADDDFQRELAGILKDYVGRESPLYFAERLTEHYRRENGEGPLIYLKREDLNHTGAHKINNAVAQALLAKRLGKKRIIAETGAGQHGVATATVCARFGLDCIIYMGAQDMERQALNVFRMRLLGAEVRGVHSGTATLKDATSEAIRDWVTNVETTHYILGSVAGPHPYPMMVRDFHAVIGKETRRQAMEKWGGKPDVLVACVGGGSNAMGLFHEFVDDTEVRLIGVEAAGFGVDSGKHAATLTKGDVGVLHGAMSYLLQDDDGQIIEPHSISAGLDYPGVGPEHSFLKDMGRAEYFSVTDEEALEAFKRVSRLEGIIPALETSHALAHLEKLCPTLPDGARVVLNFSGRGDKDVQTVAKYLEV

SEQ ID NO: 5084 - protein, 232 aa, Taraxacum officinale
MAFSLTTPAPGTTATATATATVSSSSSSLFLNPYPSQLSLRLNKFGSLSPKSFSVSCVLAKQSTGQMELGKSAVIQDGLSVLQRPDSLGRFGKYGGKYVPETLMFALSELESAFKALATDDEFQKELAGILKDYVGRESPLYFAERLTEHYKRDNGEGPEIYLKREDLNHTGAHKINNAVAQALLAKKLGKKRIIAETGAGQHGVATATVCARFWVGVYYLYGCSRYGKTSS

SEQ ID NO: 5085 - protein, 475 aa, Arabidopsis thaliana
MATASTAATFRPSSVSASSELTHLRSPSKLPKFTPLPSARSRSSSSFSVSCTIAKDPAVVMADSEKIKAAGSDPTMWQRPDSFGRFGKFGGKYVPETLMHALSELETAFYSLATDEDFQRELAEILKDYVGRESPLYFAERLTEHYRRENGEGPLIYLKREDLNHTGAHKINNAVAQALLAKRLGKKRIIAETGAGQHGVATATVCARFGLQCIIYMGAQDMERQALNVFRMRLLGAEVRGVHSGTATLKDATSEAIRDWVTNVETTHYILGSVAGPHPYPMMVRDFHAVIGKETRKQAMEKWGGKPDVLVACVGGGSNAMGLFHEFVDDTEVRMIGVEAAGFGLDSGKHAATLTKGDVGVLHGAMSYLLQDDDGQIIEPHSISAGLDYPGVGPEHSFLKDVGRAEYFSVTDEEALEAFKRVSRLEGIIPALETSHALAHLEKLCPTLPDGARVVLNFSGRGDKDVQTAIKYLEV

SEQ ID NO: 5086 - protein, 471 aa, Arabidopsis lyrata
MAASGTAATFRASVSSAPSSSSSQLTHLRSSPFKALKFTPLPSSRSKSSFSVTCTIAKDPPVLMTAGSDPTLWQRPDSFGRFGKFGGKYVPETLMHALSELESAFYALATDDDFQRELAGILKDYVGRESPLYFAERLTEHYRRENGEGPLIYLKREDLNHTGAHKINNAVAQALLAKRLGKKRIIAETGAGQHGVATATVCARFGLECIIYMGAQDMERQALNVFRMRLLGAEVRGVHSGTATLKDATSEAIRDWVTNVETTHYILGSVAGPHPYPMMVRDFHAVIGKETRRQALEKWGGKPDVLVACVGGGSNAMGLFHEFVNDTEVRMIGVEAAGFGLDSGKHAATLTKGDVGVLHGAMSYLLQDDDGQIIEPHSISAGLDYPGVGPEHSFFKDMGRAEYYSITDEEALEAFKRVSRLEGIIPALETSHALAYLEKLCPTLSDGTRVVLNFSGRGDKDVQTVAKYLDV

SEQ ID NO: 5087 - protein, 466 aa, Tropaeolum majus
MAASTCNPHASSLQKPISSSSSLIPSRLPFNSNTLSCKKPSKTPFSVSCTLTRDPMEDTNGVIDPIQWQRPDSFGRFGKYGGKYVPETLMYALTELETAFKALASDEEFQTELAGILKDYVGRENPLYFAERLTEHYKRPNGEGPHVYLKREDLNHTGAHKINNAVAQALLAKRLGKKRIIAETGAGQHGVATATVCARFGLPCIIYMGAQDMERQALNVFRMRLLGAEVRGVHSGTATLKDATSEAIRDWVTNVETTHYILGSVAGPHPYPMMVRDFHAIIGKETRKQALEKWGGKPDVLVACVGGGSNAMGLFHEFVNDTDVRIVGVEAAGFGLDSGKHAATLTKGEIGVLHGAMSYLLQDEDGQIVEPHSISAGLDYPGVGPEHSFLKDAGRVEYHSVTDAEALEAFKRLSRLEGIIPALETSHALAHLEKLCPTLPDGTKVVLCCSGRGDKDVHTAIKHLDV

SEQ ID NO: 5088 - protein, 235 aa, Solanum phureja
MDLNYLFISLTPSWTSVAMLIGYFLYLATVGSILPGKLVPGATLSDGTRLHYRCNGLLSLLLLVLLLGVGSQMNLVSPTAIADRGLELLSTTFIFSVLVTLMLYLVGLNSRAKSSSLKPHVSGNLIHDWWFGIQLNPEFMGIDLKFFFVRAGMMGWLLINLSVLAKCVIEAKLSQSMILYQLFCGLYILDYFFYEEFMTSTWDIIAERLGFMLVFGDLVFIPFTFSIQAWLVAFE

SEQ ID NO: 5089 - protein, 369 aa, Mimulus guttatus
MDLNALLHAFTPSWTSVAMLMAFFTYLAIAGSILPGRVVPGATLSDGTRLHYRCNGSLLLILLISLLGVGGWMDLVSPTAIADRGFELLSTTLIFSLFVTLLLYIAGCRSRDQSSSLKPHITGNLIHDWWFGIQLNPQFIGIDLKFFFVRAGMMGWLLINLSVLAKCIQQVNLSVSMILYQIFCVLYILDYFFYEEYMTSTWDIIAERLGFMLVFGDLVWIPFTFSIQGWWLLNNNVELTTAAIIANCLAFLIGYLVFRGANKQKHIFKKNPKALIWGSPPKVIGGKLLASGYWGIARHSNYLGDLLVALSFSLPCGISSPVPYFYPIYLFILLIWRERRDEARCAQKYKEIWAEYRKLVPWRILPYVY

SEQ ID NO: 5090 - protein, 369 aa, Triphysaria pusilla
MDLNALLHASTPSWTSVAILLGFFTYLAIVGSILPGKIVPGATLSDGTRLHYRCNGFLLLVLLVCLLGVGGWMDLVSLTAIADRGLELFSTTLIFSVIVTLVLYVAGCRSRAQSSSLKPHISGNLIHDGWFGIQLNPEFMGIDLKFYFVRAGMMGWLLINLSVLAKCIQETNLSQSMTLYQIFCLIYVLDYFLYEEYMTSTWDIIAERLGFMLVFGDLVWIPFTFSIQSWWLLNNEVELTTAGIIANCLVFLIGYMVFRGSNKQKHDFKKNPKALIWGRPPKVIGGKLLASGYWGIARHSNYLGDLLLALSFSLPCGISSPVPYFYPIYLFILLLWRERRDDARCAQKYKEIWAEYTKLVPWRILPYVY

SEQ ID NO: 5091 - protein, 238 aa, Mimulus guttatus
MDLNALLHAFTPSWTSVAMLMAFFTYLAIAGSILPGRVVPGATLSDGTRLHYRCNGSLLLILLISLLGVGGWMDLVSPTAIADRGFELLSTTLIFSLFVTLLLYIAGCRSRDQSSSLKPHITGNLIHDWWFGIQLNPQFIGIDLKFFFVRAGMMGWLLINLSVLAKCIQQVNLSVSMILYQIFCVLYILDYFFYEEYMTSTWDIIAERLGFMLVFGDLVWIPFTFSIQGWWLLNNNVS

SEQ ID NO: 5092 - protein, 257 aa, Triphysaria pusilla
MDLNALLHASTPSWTSVAILLGFFTYLAIVGSILPGKIVPGATLSDGTRLHYRCNGFLLLVLLVCLLGVGGWMDLVSLTAIADRGLELFSTTLIFSVIVTLVLYVAGCRSRAQSSSLKPHISGNLIHDGWFGIQLNPEFMGIDLKFYFVRAGMMGWLLINLSVLAKCIQETNLSQSMTLYQIFCLIYVLDYFLYEEYMTSTWDIIAERLGFMLVFGDLVWIPFTFSIQSWWLLIMKWSLQLLGLCKLPRLSDWLYGL

SEQ ID NO: 5093 - protein, 369 aa, Cajanus cajan
MDLGILLHALIPSWNSVPLLLGFFTYLAIAGSILPGKLVPGVALPDATRLHYRCNGLLSLLLLVALLGISGKMGFVTPTAISDRGLELLSTTFVFSFLVTLVLYFSGCKSQSKGSSLKPHISGNLIHDWWFGIQLNPQFMGIDLKFFFVRAGMMGWLLINLSILMKSIQDGTLSQSMILYQLFCALYILDYFVHEEYMTSTWDIIAERLGFMLVFGDLVWIPFTFSIQGWWLLRNNVELTTAATVANCFVFLIGYMVFRGANKQKHMFKKNPKAPIWGKPPKVVGGKLLASGYWGIARHCNYLGDLLLALSFSLPCGISSPIPYFYPIYLLILLIWRERRDEARCAEKYREIWAEYRKLVPWRILPYVY

SEQ ID NO: 5094 - protein, 369 aa, Malus domestica
MDLDHLLHLLIPSWTSVAILALFFTYLAIAGSLLPGKLVPGATLPDGSRLHYRCNGLLSLLWLVGLLGVGAKMDIVSLTAISDRGLELLSTTFLFSVLVTMVLYAAGCKSTNRGSSLKPHVTGNLLEDWWFGIQLNPQFMGIDLKFFFVRAGMMGWLFINLSVLARSVQDGTLSQSMILYQLFCTLYILDYFVHEEYMTSTWDIIAERLGFMLVFGDLVWIPFTFSIQGWWLLSNKVELGTVAVVANCLTFLIGYLVFRGANKQKHVFKKNPKAPIWGKPCRVIGGKLLASGYWGIARHCNYLGDLLLALSFSLPCGISSPVPYFYPIYLLILLIWRERRDEARCAEKYREIWAEYCRLVPWRILPYVY

SEQ ID NO: 5095 - protein, 369 aa, Prunus persica
MDLGHVLHLLIPSWNSVAILALFFAYLSIAGSILPGKVVPGATLPDGSRLYYRCNGLLSLLLLVGLLGFGAKMDFVSLTAISDRGFELLSTTFLFSVLVTLVLYAAGCKSSNRGSSLKPHVTGNLLHDWWFGIQLNPQFMGIDLKFFFVRAGMMGWLFINLSVLARSIQDGTLSQSMILFQLFCALYILDYFFHEEYMTSTWDIIAERLGFMLVFGDLVWIPFTFSIQGWWLLSNKVELGTAAVVANCLTFLIGYMVFRGANKQKHVFKKNPKAPIWGRPARVIGGKLLASGYWGIARHCNYLGDLLLALSFSLPCGISSPVPYFYPIYLLILLVWRERRDEARCAEKYKEIWAEYRKLVPWRILPYVY

SEQ ID NO: 5096 - protein, 373 aa, Glycine max
MESHVDLGFLLQALTPSWNSVPLLVGFFTYLAVAGSILPGKLVPGVALLDGTRLHYCCNGLLSLLLLVALLGIGAKMGFVSPTAISDRGLELLSTTFAFSFLVTLILHFSGCKSQSKGSSLKPHLSGNLIHDWWFGIQLNPQFMGIDLKFFFVRAGMMGWLLINLSILMKSIQDGTLSQSMILYQLFCALYILDYFVHEEYMTSTWDIIAERLGFMLVFGDLVWIPFSFSIQGWWLLMNSVELTPAAIVANCFVFLIGYMVFRGANKQKHVFKKNPKAPIWGKPPKVIGGKLLASGYWGIARHCNYLGDLMLALSFSLPCGISSPIPYFYPIYLLILLIWRERRDEARCAEKYREIWAEYRKLVPWRILPYVY

SEQ ID NO: 5097 - protein, 235 aa, Prunus persica
MDLGHVLHLLIPSWNSVAILALFFAYLSIAGSILPGKVVPGATLPDGSRLYYRCNGLLSLLLLVGLLGFGAKMDFVSLTAISDRGFELLSTTFLFSVLVTLVLYAAGCKSSNRGSSLKPHVTGNLLHDWWFGIQLNPQFMGIDLKFFFVRAGMMGWLFINLSVLARSIQDGTLSQSMILFQLFCALYILDYFFHEEYMTSTWDIIAERLGFMLVFGDLVWIPFTFSIQAWMVASE

SEQ ID NO: 5098 - protein, 373 aa, Vigna unguiculata
  misc_feature (178)..(178): Xaa can be any naturally occurring amino acid
MESHVDLGFLLHALMPSWNSVPLLSGFFTYLAIAGSVLPGKVVPGVALPDATRLHYRCNGLLSLLLLVALLGIGANMGFVSPTAISDRGLELLSTTFLFSFLVTLVLYFSGCESQSKGSSLKPHISGNLIHDWWFGIQLNPHFMGIDLKFFFVRAGMMGWLLINLSILMKSIQDGTLXQSMILYQLFCALYILDYFVHEEYMTSTWDIIAERLGFMLVFGDLVWIPFTFSIQGWWLLKNSVELTTAAVVANCFVFLIGYMVFRGANKQKHVFKKNPKAPIWGKPPKVVGGKLLASGYWGVARHCNYLGDLLLALSFSLPCGISSPIPYFYPVYLLILLIWRERRDETRCAEKYKEIWAEYRKLVPWRILPYVY

SEQ ID NO: 5099 - protein, 246 aa, Unknown
  Sequence found in Organisms: Solanum tuberosum, Solanum phureja
MASNTLMSYGIAPVCPSILSASKSKFVTALPVSAGVTNDTSRFTMSADWMPGQPRPSYLDGSAPGDFGFDPLGFGEVPENLERYKESELIHCRWAMLAVPGIIVPEALGLGNWVKAQEWAAIPGGQATYLGQPVPWGTLPTILVIEFLAIAFVEHQRSMEKDSEKKKYPGGAFDPLGYSKDPAKFEELKVKEIKNGRLALLAFVGFCVQQSAYPGTGPLENLATHLADPWHNNIGDVVIPKGIFPN

SEQ ID NO: 5100 - protein, 240 aa, Solanum tuberosum
MSYGIAPVCPSILSASKSKFVTALPVSAGVTNDTSRFTMSADWMPGQPRPSYLDGSAPGDFGFDPLGFGEVPENLERYKESELIHCRWAMLAVPGIIVPEALGLGNWVKAQEWAAIPGGQATYLGQPVPWGTLPTILVIEFLAIAFVEHQRSMEKDSEKKKYPGGAFDPLGYSKDPAKFEELKVKEIKNGRLALLAFVGFCVQQSAYPGTGPLENLATHLADPWHNNIGDVIIPKGIFPN

SEQ ID NO: 5101 - protein, 246 aa, Solanum tuberosum
MASNTLMSCGIPAVCPSFLSSSKSKFAAAMPVSVGATNSMSRFSMSADWMPGQPRPSYLDGSAPGDFGFDPLGFGEVPENLERYKESELIHCRWAMLAVPGILVPEALGLGNWVKAQEWAAIPGGQATYLGQPVPWGTLPTILVIEFLAIAFVEHQRSMEKDSEKKKYPGGAFDPLGYSKDPAKFEELKVKEIKNGRLALLAFVGFCVQQSAYPGTGPLENLATHLADPWHNNIGDVVIPKGIFPN

SEQ ID NO: 5102 - protein, 246 aa, Solanum lycopersicum
MASNTLMSCGIPAVCPSFLSSTKSKFAAAMPVSVGATNSMSRFSMSADWMPGQPRPSYLDGSAPGDFGFDPLGLGEVPANLERYKESELIHCRWAMLAVPGIIVPEALGLGNWVKAQEWAAIPGGQATYLGQPVPWGTLPTILAIEFLAIAFVEHQRSMEKDSEKKKYPGGAFDPLGYSKDPAKFEELKVKEIKNGRLALLAFVGFCVQQSAYPGTGPLENLATHLADPWHNNIGDVIIPKGIFPN

SEQ ID NO: 5103 - protein, 246 aa, Unknown
  Sequence found in Organisms: Solanum tuberosum, Solanum phureja
MASNTLMSCGIPAVCPSFLSSSKSKFAAAMPVSVGATNSMSRFSMSSDWMPGQPRPSYLDGSAPGDFGFDPLGFGEVPENLERYKESELIHCRWAMLAVPGILVPEALGLGNWVKAQEWAAIPGGQATYLGQPVPWGTLPTILVIEFLAIAFVEHQRSMEKDSEKKKYPGGAFDPLGYSKDPAKFEELKVKEIKNGRLALLAFVGFCVQQSAYPGTGPLENLATHLADPWHNNIGDVVIPKGIFPN

SEQ ID NO: 5104 - protein, 246 aa, Capsicum annuum
MACNTLMSCGIAAVCPSFLSSSKSKFAAAMPVSAGANNAMSRFTMSADWMPGQPRPSYLDGSAPGDFGFDPLGFGEVPENLERYKESELIHCRWAMLAVPGILVPEALGLGNWVKAQEWAAIPGGQATYLGQPVPWGTLPTILVIEFLAIAFVEHQRSMEKDTEKKKYPGGAFDPLGYSKDPKKFEEYKVKEIKNGRLALLAFVGFCVQQSAYPGTGPLENLATHLADPWHNNIGDVIIPKGIFPN

SEQ ID NO: 5105 - protein, 247 aa, Solanum melongena
MASKSLMSCGIAPVCPSFLSSSNSKLFAGAMRLPAGVTDSMSRLSMSADWMPGQPRPSYLDGSAPGDFGFDPLGFGEVPENLERYKESELIHCRWAMLAVPGILVPEALGLGNWVKAQEWAAIPGGQATYLGQPVPWGTLPTILVIEFLAIAFVEHQRSMEKDTEKKKYPGGAFDPLGYSKDPAKFEELKVKEIKNGRLALLAFVGFCVQQSAYPGTGPLENLATHLADPWHNNIGDVIIPKGIFPN

SEQ ID NO: 5106 - protein, 245 aa, Nicotiana tabacum
MASKALMSCGIAAVCPSVLSSSKSKFAVAVPVSAGATNGTSRFTMSAEWMPGQPRPSYLDGSAPGDFGFDPLGLGEVPSNLERYKESELIHCRWAMLAVPGILVPEALGLGNWVKAQEWAAIPGGQATYLGQPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHNNIGDVIIPRGILP

SEQ ID NO: 5107 - protein, 245 aa, Nicotiana benthamiana
MASKALMSCGIAAVCPSVLSSSKSKFAAAVPVSAGASNTTSRFTMSAEWMPGQPRPSYLDGSAPGDFGFDPLGLGEVPSNLERYKESELIHCRWAMLAVPGILVPEALGLGNWVKAQEWAAIPGGQATYLGQPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHNNIGDVIIPRGILP

SEQ ID NO: 5108 - protein, 245 aa, Nicotiana tabacum
MASKALMSCGIAAVCPSVLSSSKSKFAAAVPFSAGATNATSRFTMSAEWMPGQPRPSYLDGSAPGDFGFDPLGLGEVPSNLERYKESELIHCRWAMLAVPGILVPEALGLGNWVKAQEWAAIPGGQATYLGQPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHNNIGDVIIPRGILP

SEQ ID NO: 5109 - protein, 245 aa, Nicotiana tabacum
MASNTLMSCGIAAVSPSVLSSSKSKFAAAVPVCLGAANANSRFSMSAEWMPGQPRPPYLDGSAPGDFGFDPLGLGEVPANLERYKESELIHCRWAMLAVPGILVPEALGLGNWVKAQEWAAIPGGQATYLGQPVPWGTLPTILAIEFLAIAFVEHQRSMEKDPEKKKYPGGAFDPLGYSKDPKKFEELKVKEVKNGRLALLAFVGFCVQQSAYPGTGPLENLATHLADPWHNNIGDVIIPKGILP

SEQ ID NO: 5110 - protein, 245 aa, Unknown
  Sequence found in Organisms: Nicotiana benthamiana, Nicotiana tabacum
MASNALMSCGIAAVSPSVLSSSKSKFAVAVPVCVGAANGNSRFSMSAEWMPGQPRPPYLDGSAPGDFGFDPLGLGEVPANLERYKESELIHCRWAMLAVPGILVPEALGLGNWVKAQEWAAIPGGQATYLGQPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHNNIGDVIIPRGILP

SEQ ID NO: 5111 - protein, 245 aa, Nicotiana benthamiana
MASKALMSCGVAAVCPSVLSSSKSKFAAAVQISAGHTNATSRFTMSAEWMPGQPRPSYLDGSAPGDFGFDPLGLGEVPSNLERYKESELIHCRWAMLAVPGILVPEALGLGNWVKAQEWAAIPGGQATYLGQPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHNNIGDVIIPRGILP

SEQ ID NO: 5112 - protein, 245 aa, Petunia hybrida
MASKALMSCGIAAVCPSVLSSSKSKFAVAVPVSAGATNGTSRFTMSAEWMPGQPRPSYLDGSAPGDFGFDPLGLGEVPSNLERYKESELIHCRWAMLAVPGILVPEALGLGNWVKAQEWAAIPGGQATYLGQPVPWGTLPTILAIEFLAIAFVEHQRSMEKDPEKKKYPGGAFDPWGYSKDPKKFEELKVKEIKNGRLALLAFVGFCVQQSAYPGTGPLENLATHLADPWHKNIGDIIIPPSVFP

SEQ ID NO: 5113 - protein, 245 aa, Nicotiana benthamiana
MASNALMSCGIAAVSPSVLSSSKSKFAVAVPVCVGAANGNSRLSMSAEWMPGQPRPPYLDGSAPGDFGFDPLGLGEVPANLERYKESELIHCRWAMLAVPGILVPEALDLGNWVKAQEWAAIPGGQATYLGQPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHNNIGNVIIPRGILP

SEQ ID NO: 5114 - protein, 246 aa, Lactuca sativa
MASNTLMSCGIPAVGRPSLLSSSKSRFATAVPLSGVTTNASRISMSAEWMPGQPRPPYLDGSAPGDFGFDPLGLGEVPENLERFKESELIHCRWAMLAVPGILLPEALGLGNWVKAQEWAALPGGQATYLGNPVPWGTLPTILAIEFISIAFVEHQRSMEKDTEKKKYPGGAFDPLGYSKDPKTFAEYKVKEIKNGRLALLAFVGFCVQQSAYPGTGPLENLATHLADPWHNNIGDVIIPKGIFPN

SEQ ID NO: 5115 - protein, 244 aa, Antirrhinum majus
MAANTLMSCGVAAVAPSVLSSSKSKFAASANFGTTASTSRFTMSAEWMPGQPRPSYLDGSAPGDYGFDPLGLGEVPSNLERYKESELIHCRWAMLAVPGILVPEALGLGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDVVIPPGIFPN

SEQ ID NO: 5116 - protein, 246 aa, Lactuca sativa
MASNTLMSCGIPAVGRPSLLSSSKSRFATAVPLSGVTTNASRICMSAEWMPGQPRPPYLDGSAPGDFGFDPLGLGEVPENLERFKESELIHCRWAMLAVPGILLPEALGLGNWVKAQEWAALPGGQATYLGNPVPWGTLPTILAIEFISIAFVEHQRSMEKDTEKKKYPGGAFDPLGYSKDPKTFAEYKVKEIKNGRLALLAFVGFCVQQSAYPGTGPLENLATHLADPWHNNIGDVIIPKGIFPN

SEQ ID NO: 5117 - protein, 246 aa, Lactuca sativa
MASNTLMSCGIPAVGRPSLLSSSKSRFATAVPLSGVTTNASRISMSAEWMPGQPRPPYLDGSAPGDFGFDPLGLGEVPANLERFKESELIHCRWAMLAVPGILLPEALGLGNWVKAQEWAALPGGQATYLGNPVPWGTLPTILAIEFVSIAFVEHQRSMEKDTEKKKYPGGAFDPLGYSKDPKTFAEYKVKEIKNGRLALLAFVGFCVQQSAYPGTGPLENLATHLADPWHNNIGDVIIPKGIFPN

SEQ ID NO: 5118 - protein, 247 aa, Prunus persica
MASNTLMSCGIATTAFPSVLSSSKSKFATSAVQLPSVGANASSRFSMSADWMPGQPRPPYLDGSAPGDFGFDPLRLGEVPENLERFKESELIHCRWAMLAVPGILVPEALGLGNWVKAQEWAAVPGGQATYLGNPVPWGTLPTILVIEFLSIAFVEHQRSMEKDPEKKKYPGGAFDPLGYSKDPKKFEEYKVKEIKNGRLALLAFVGFVVQQSAYPGTGPLENLATHLADPWHNNIGDVIIPKGILP

SEQ ID NO: 5119 - protein, 246 aa, Actinidia deliciosa
MASNTLMSYGMAAVLRPSIQSPSKSKCAALPLLNRRAASTTCRFSMSADWMPGQPRPPYLDGSAPGDFGFDPLGLGEVPENLERYKESELIHCRWAMLAVPGILVPEALGLGNWVKAQEWAAIPGGQATYLGQPVPWGTLPTILVIEFLAIAFVEHQRSMEKDTEKKKYPGGAFDPLGYSKDPAKFEEYKVKEVKNGRLALLAFVGICVQQSAYPGTGPLENLATHLADPWHNNIGDVLIPRTIYP

SEQ ID NO: 5120 - protein, 246 aa, Centaurea maculosa
MASNTLMSCGIPAVGRPSILSSSRSRFATAVPLSGVATNASRISMTADWMPGQPRPPYLDGSAPGDFGFDPLRLGEVPENLERFKESELIHCRWAMLAVPGILLPEALGLGNWVKAQEWAALPGGQATYLGNPVPWGTLPTILAIEFISIAFVEHQRSMEKDPEKKKYPGGAFDPLGYSKDPKTFAEYKVKEIKNGRLALLAFVGFCVQQSAYPGTGPLENLATHLADPWHNNIGDVIIPKGIFPN

SEQ ID NO: 5121 - protein, 246 aa, Taraxacum officinale
MASNTLMSCGIPAVGRPSLLSSSKSRFATAVPLSGVATNASRISMTSDWMPGQPRPSYLDGSAPGDFGFDPLRLGEVPENLERFKESELIHCRWAMLAVPGILLPEALGLGNWVKAQEWAALPGGQATYLGNPVPWGTLPTILAIEFISIAFVEHQRSMEKDPEKKKYPGGAFDPLGYSKDPKTFAEYKVKEIKNGRLALLAFVGFCVQQSAYPGTGPLENLATHLADPWHNNIGDVIIPKGIFPN

SEQ ID NO: 5122 - protein, 246 aa, Lactuca sativa
MASNTLRRLYIPAVGRPSLLSSSKSRFATAVPLSGVTTNASRISMSAEWMPGQPRPPYLDGSAPGDFGFDPLGLGEVPENLERFKESELIHCRWAMLAVPGILLPEALGLGNWVKAQEWAALPGGQATYLGNPVPWGTLPTILAIEFISIAFVEHQRSMEKDTEKKKYPGGAFDPLGYSKDPKTFAEYKVKEIKNGRLALLAFVGFCVQQSAYPGTGPLENLATHLADPWHNNIGDVIIPKGIFPN

SEQ ID NO: 5123 - protein, 246 aa, Cucumis sativus
MASNTLMSCGIATTAFPSVLSSSKSKFAVGVPISGVAVNASSRFSMSAEWMPGQPRPPYLDGSAPGDFGFDPLGLGEVPENLERFKESELIHCRWAMLAVPGILVPEALGLGNWVKAQEWAAVPGGQATYLGQPVPWGTLPTILVIEFLAIAFVEHQRSMEKDPEKKKYPGGAFDPLGYSKDPEKLKEYKVKEIKNGRLALLAFVGFCVQQSAYPGTGPLENLATHLADPWHNNIGDIIIPRTISP

SEQ ID NO: 5124 - protein, 247 aa, Malus domestica
MASNTLMSCGIATTAFPSVLSSSKSKFATSAVQLPSIGANASSRFSMSAEWMPGEPRPPYLDGSAPGDFGFDPLRLGEVPENLERFKESELIHCRWAMLAVPGILVPEALGLGNWVKAQEWAAVPGGQATYLGNPVPWGTLPTILVIEFLSIAFVEHQRSMEKDPEKKKYPGGAFDPLGYSKDPKKFEEYKVKEVKNGRLALLAFVGFVVQQSAYPGTGPLENLATHLADPWHNNIGDVIIPKGILP

SEQ ID NO: 5125 - protein, 247 aa, Malus domestica
MASNTLMSCGIATTAFPSVLSSSKSKFATSAVQLPSVGANASSRFSMSADWMPGEPRPPYLDGSAPGDFGFDPLRLGEVPENLERFKESELIHCRWAMLAVPGILVPEALGLGNWVKAQEWAAVPGGQATYLGNPVPWGTLPTILVIEFLSIAFVEHQRSMEKDTEKKKYPGGAFDPLGYSKDPKKFEEYKVKEIKNGRLALLAFVGFVVQQSAYPGTGPLENLATHLADPWHNNIGDVLIPKGILP

SEQ ID NO: 5126 - protein, 246 aa, Cucumis melo
MASNTLMSCGIATTAFPSVLSSSKSKFAAAVPISGVAVNASSRFSMSSEWMPGQPRPPYLDGSAPGDFGFDPLRLGEVPENLERFKESELIHCRWAMLAVPGILVPEALGLGNWVKAQEWAAVPGGQATYLGQPVPWGTLPTILVIEFLAIAFVEHQRSMEKDPEKKKYPGGAFDPLGYSKDPEKLKEYKVKEIKNGRLALLAFVGFCVQQSAYPGTGPLENLATHLADPWHNNIGDIIIPRTISP

SEQ ID NO: 5127 - protein, 246 aa, Artemisia annua
MASNTLMSCGIAAVARPSMFSSSKSRFATAVPLSGVATNASRVSMTADWMPGQPRPPYLDGSAPGDFGFDPLRLGEVPSNLERFKESELIHCRWAMLAVPGILLPEALGLGNWVKAQEWAAVPGGQATYLGNPVPWGTLPTILAIEFVSIAFVEHQRSMEKDPEKKKYPGGAFDPLGYSKDPKTFAENKVKEIKNGRLALLAFVGFVVQQSAYPGTGPLENLATHLADPWHNNIGDVIIPKGIFPN

SEQ ID NO: 5128 - protein, 246 aa, Artemisia annua
MASNTLMSCGIAAVARPSMFSSSKSRFATAVPLSGVATNASRVSMTADWMPGQPRPPYLDGSAPGDFGFDPLRLGEVPSNLERFKESELIHCRWAMLAVPGILLPEALGLGNWVKAQEWAAVPGGQATYLGNPVPWGTLPTILAIEFVSIAFVEHQRSMEKDPEKKKYPGGAFDPLGYSKDPKTFAEYKVKEIKNGRLALLAFVGFVVQQSAYPGTGPLENLATHLADPWHNNIGDVIIPKGIFPN

SEQ ID NO: 5129 - protein, 246 aa, Senecio madagascariensis
MAANTLMSCGIAPLGRPSMFSSSKSRFATAVPFSAVATNGSRLSMTSDWMPGQPRPSYLDGSAPGDFGFDPLGLGSVPENLERFKESELIHCRWAMLAVPGILLPEALGLGNWVKAQEWAALPGGQATYLGNPVPWGTLPTILAIEFISIAFVEHQRSMEKDTEKKKYPGGAFDPLGYSKDPKTFAEYKVKEIKNGRLALLAFVGFCVQQSAYPGTGPLENLATHLADPWHNNIGDVVIPKGIFPN

SEQ ID NO: 5130 - protein, 247 aa, Fragaria vesca
MASNTLMSCGIATTAFPSVLSSSKSKFATAVQLPSVGANASSRFSMSAEWMPGQPRPPYLDGSAPGDFGFDPLRLGEVPENLERFKESELIHCRWAMLAVPGILVPEALGLGNWVKAQEWAALPGGQATYLGNPVPWGTLPTILVIEFLSIAFVEHQRSMEKDPEKKKYPGGAFDPLGYSKDPKKFEEYKVKEVKNGRLALLAFVGFVVQQSAYPGTGPLENLATHLADPWHNNIGDIIIPKGLLPN

SEQ ID NO: 5131 - protein, 246 aa, Helianthus annuus
MASNTLMSCGISAVCRPSLFSSSKSRFATAVPLSGVATNASRISMTADWMPGQPRPPYLDGSAPGDFGFDPLRLGEVPENLERFKESELIHCRWAMLAVPGILLPEALGLGNWVKAQEWAAVPGGQATYLGNPVPWGTLPTILAIEFVSIAFVEHQRSMEKDPEKKKYPGGAFDPLGYSKDPKKFEEYKVKEIKNGRLALLAFVGFCVQQSAYPGTGPLENLATHLADPWHNNIGDIVIPKGVFPN

SEQ ID NO: 5132 - protein, 246 aa, Helianthus annuus
MASNTLMSCGISAVCRPSLFSSSKSRFATAVPLSGVATNASRISMTADWMPGQPRPPYLDGSAPGDFGFDPLRLGEVPENLERFKESELIHCRWAMLAVPGILLPEALGLGNWVKAQEWAAVPGGQATYLGNPVPWGTLPTILAIEFVSIAFVEHQRSMEKDPEKKKYPGGAFDPLGYSKDPKKFAEYKVKEIKNGRLALLAFVGFCVQQSAYPGTGPLENLATHLADPWHNNIGDIVIPKGVFPN

SEQ ID NO: 5133 - protein, 245 aa, Catharanthus roseus
MAANTLMSCGVAAVCPSVLSSSKSKFASSLPLPSGVAAANGSAKMSADWMPGQPRPPYLDGSAPGDFGFDPLRLGEVPENLERYKESELIHCRWAMLAVPGILVPEALGYGNWVKAQEWAAVPGGQATYLGNPVPWGTLPTILVIEFLAIAFVEHQRSMEKDPEKKKYPGGAFDPLGYSKDPAKFEELKVKEIKNGRLALLAFVGFCVQQSAYPGTGPLENLATHLADPWHNNIGDIIIPTSLLP

SEQ ID NO: 5134 - protein, 246 aa, Helianthus annuus
MASNSLMSSGIPGVCRPAVLSSSKSRFATAVPLSGVATNASRISMTADWMPGQPRPPYLDGSAPGDFGFDPLRLGEVPENLERFKESELIHCRWAMLAVPGILLPEALGLGNWVKAQEWAAVPGGQATYLGNPVPWGTLPTILAIEFISIAFVEHQRSMEKDPEKKKYPGGAFDPLGYSKDPKAFAEYKVKEIKNGRLALLAFVGFCVQQSAYPGTGPLENLATHLADPWHNNIGDIIIPKGIFPN

SEQ ID NO: 5135 - protein, 247 aa, Gossypium hirsutum
MAANTLMSCGIATTFPSLLSSSKSKFSGAAVSLPSAVGTNVGHRVSMSADWMPGQPRPPYLDGSAPGDFGFDPLRLGEVPENLERYKESELIHCRWAMLAVPGILVPEALGLGNWVKAQEWAAIPGGQATYLGNPVPWGTLPTILVIEFLSIAFVEHQRSMEKDTEKKKYPGGAFDPLGFSKDPKKFEEYKVKEIKNGRLALLAFVGFCVQQSAYPGTGPLENLATHLADPWHNNIGDVIIPRSLYP

SEQ ID NO: 5136 - protein, 246 aa, Gossypium hirsutum
MAATNTLMSCGIATAFPSVLSSSKSKFATATPLPSFGANVGHRVSMSADWMPGQPRPPYLDGSAPGDFGFDPLRLGEVPENLERYKESELIHCRWAMLAVPGILVPEALGYGNWVKAQEWAAVPGGQATYLGNPVPWGTLPTILVIEFLAIAFVEHQRSMEKDTEKKKYPGGAFDPLGYSKDPKKFEEYKVKEIKNGRLALLAFVGFCVQQSAYPGTGPLENLATHLADPWHNNIGDIIIPRSISP

SEQ ID NO: 5137 - protein, 243 aa, Beta vulgaris
  misc_feature (242)..(242): Xaa can be any naturally occurring amino acid
MASNALTSCGIAAVFPSSLSSSKSKFAASVPLVNLSCNVSSRFTMSAEWMPGQPRPPYLDGSAPGDFGFDPLRLGEVPENLERFKESELIHCRWAMLAVPGILVPEALGLGNWVKAQEWAALPGGQATYLGNPVPWGNLPTILAIEFLAIAFVEHQRSMEKDSEKKKYPGGAFDPLGYSKDPKKFEELKVKEIKNGRLALLAFVGFCVQQSAYPGTGPLENLATHLADPWHNNIGDILIPPXL

SEQ ID NO: 5138 - protein, 244 aa, Ricinus communis
MATNTLMSCGIATAFPSLLSSSKSKFASSVPLPCVNGSSSRITMSADWMPGQPRPPYLDGSAPGDFGFDPLRLGEVPENLERFKESELIHCRWAMLAVPGILVPEALGLGNWVKAQEWAAIPGGQATYLGQPVPWGTLPTILVIEFLAIAFVEHQRSMEKDPEKKKYPGGAFDPLGYSKDPAKFHEYKVKEIKNGRLALLAFVGICVQQSAYPGTGPLENLATHLADPWHNNIGDIIIPTSFSP

SEQ ID NO: 5139 - protein, 244 aa, Castanea mollissima
MAANRLMSCGIATTAFPSVLSSSKSKFATATPLSSAGANASSRFTMSAEWMPGQPRPAHLDGSAPGDFGFDPLGLGEVPENLERFKESELIHCRWAMLAVPGILVPEALGLGNWVQAQEWAAIPGGQATYLGNPVPWGTLPTILVIEFLSIAFVEHQRSMEKDPEKKKYPGGAFDPLGYSKDPKKFEEYKVKEIKNGRLALLAFVGFCVQQSAYPGTGPLENLATHLADPWHNNIGNVIIPRGL

SEQ ID NO: 5140 - protein, 246 aa, Cynara scolymus
  misc_feature (62)..(62): Xaa can be any naturally occurring amino acid
  misc_feature (159)..(159): Xaa can be any naturally occurring amino acid
  misc_feature (179)..(179): Xaa can be any naturally occurring amino acid
MASNTLMSCGIPAVGRPSLLSSSKSRFAAAVPLSGVATNASRISMTADWMPGQPRPPYLDGXAPGDFGFDPLRLGEVPENLERFKESELIHCRWAMLAVPGILLPEALGLGNWVKAQEWAALPGGQATYLGNPVPWGTLPTILAIEFISIAFVEHQRSXEKDPEKKKYPGGAFDPLGYXKDPKAFAEYKVKEIKNGRLALLAFVGFCVQQSAYPGTGPLENLATHLADPWHNNIGDVIIPKGIFPN

SEQ ID NO: 5141 - protein, 243 aa, Populus trichocarpa
MATNTLMSCGIATAFPSLLSSSKSKFASSIPLPSVNGTSRVTMSANWMPGQPRPPYLDGSAPGDFGFDPLRLGEVPENLERYKESELIHCRWAMLAVPGILVPEALGLGNWVKAQEWAATPGGQATYLGQPVPWGTLPIILAIEFVAIAFVEHQRSMEKDTEKKKYPGGAFDPLGYSKDPQKFEEYKVKEIKNGRLALLAFVGICVQQTAYPGTGPLENLATHLADPWHNNIGDVLIPRSVSP

SEQ ID NO: 5142 - protein, 243 aa, Euphorbia esula
MAAKTLMSCGIATAFPSLLSSSKSKFASSIPLPAVNGSSRISMTADWMPGQPRPPYLDGSAPGDFGFDPLRLGEVPENLERFKESELVHCRWAMLAVPGMLVPEALGLGNWVKAQEWAALPGGQATYLGQPVPWGTLPTILVIEFLAIAFVEHQRSMEKDPEKKKYPGGAFDPLGYSKDPAKFEEYKVKEIKNGRLALLAFVGFCVQQSAYPGTGPLENLATHLADPWHNNIGDIIIPKGLLP

SEQ ID NO: 5143 - protein, 246 aa, Helianthus annuus
MASNSLMSSGIPGVCRPAVLSSSKSRFAAAVPLSGVATNASRISMTADWMPGQPRPPYLDGSAPGDFGFDPLRLGEVPENLERFKESELIHCRWAMLAVPGILLPEALGLGNWVKAQEWAAVPGGQATYLGNPVPWGTLPTILAIEFISIAFVEHQRSMEKDPEKKKYPGGAFDPLGYSKDPKAFAEYKVKEIKNGRLALLAFVGFCVQQSAYPGTGPLENLATHLADPWHNNIGDIIIPKGIFPN

SEQ ID NO: 5144 - protein, 244 aa, Triphysaria pusilla
MAANALMSCGVAAVRPSILSSSKSKFAAPASFATNATTSRFSMSAEWMPGEPRPPYLDGSAPGDFGFDPLRLGEVPQNLERYKESELIHCRWAMLAVPGILVPEALGLGNWVKAQEWAALPGGQATYLGNPVPWGTLPTILAIEFLAIAFVEHQRSMEKDPEKRKYPGGAFDPLGYSKDSKKLQELKIKEVKNGRLALLAFVGFCVQQSAYPGTGPLENLATHLADPWHNNIGDIVIPSGIFPN

SEQ ID NO: 5145 - protein, 247 aa, Ipomoea nil
MASRLMSCGVAAVCSSVLSSSKSKFATAVPLPVAANVTASGRITMSSSDWMPGQPRPPYLDGSAPGDFGFDPLGLGEVPENLERYKESELIHCRWAMLAVPGIIIPEALGLGNWVKAQEWAAIPGGQATYLGQPVPWGTLPTILAIEFLAIAFVEHQRSMEKDTEKKKYPGGAFDPLGYSKQDPAKLHELKVKEIKNGRLALLAFVGICVQQSAYPGTGPLENLASHLADPWHNNIGDILIPRTISP

SEQ ID NO: 5146 - protein, 246 aa, Ipomoea batatas
MASKLMSCGVAAVCSSVLSSSKSKFAAAVPLPVSANVTASGRITMSADWMPGQPRPPYLDGSAPGDFGFDPLRLGEVPENLERYKESELIHCRWAMLAVPGIIIPEALGLGNWVKAQEWAAIPGGQATYLGQPVPWGTLPTILAIEFLAIAFVEHQRSMEKDTEKKKYPGGAFDPLGYSKQDPAKLHELKVKEIKNGRLALLAFVGICVQQSAYPGTGPLENLASHLADPWHNNIGDILIPRNVSP

SEQ ID NO: 5147 - protein, 247 aa, Gossypium hirsutum
  misc_feature (41)..(41): Xaa can be any naturally occurring amino acid
MAANTLMSCGIATTFPSLLSSSKSKFSGAAVSLPSAVGTNXGHRVSMSADWMPGQPRPPYLDGSAPGDFGFDPLRLGEVPENLERYKESELIHCRWAMLAVPGILVPEGLGLGNWVKAQEWAAIPGGQATYLGNPVPWGTLPTILVIEFLSIAFVEHQRSMEKDTEKKKYPGGAFDPLGFSKDPKKFEEYKVKEIKNGRLALLAFVGFCVQQSAYPGTGPLENLATHLADPWHNNIGDVIIPRSLYP

SEQ ID NO: 5148 - protein, 244 aa, Triphysaria pusilla
MAANALMSCGVAAVRPSLLSSSKSKFAAPASFATNATTSRFSMSAEWMPGEPRPPYLDGSAPGDFGFDPLRLGEVPQNLERYKESELIHCRWAMLAVPGILVPEALGLGNWVKAQEWAALPGGQATYLGNPVPWGTLPTILAIEFLAIAFVEHQRSMEKDPEKRKYPGGAFDPLGYSKDSKKLQELKIKEVKNGRLALLAFVGFCVQQSAYPGTGPLENLATHLADPWHNNIGDIVIPSGIFPN

SEQ ID NO: 5149 - protein, 244 aa, Triphysaria pusilla
MAANALMSCGVAAVRPSLLSSSKSKFASPASFATNATTSRFSMSAEWMPGEPRPPYLDGSAPGDFGFDPLRLGEVPQNLERYKESELIHCRWAMLAVPGILVPEALGLGNWVKAQEWAALPGGQATYLGNPVPWGTLPTILAIEFLAIAFVEHQRSMEKDPEKRKYPGGAFDPLGYSKDSKKLQELKIKEVKNGRLALLAFVGFCVQQSAYPGTGPLENLATHLADPWHNNIGDIVIPSGIFPN

SEQ ID NO: 5150 - protein, 243 aa, Manihot esculenta
MATNTLMSCGIATAFPSLLSSSKSKFSSSLPLPSVNGFSRFTMSADWMPGQPRPPYLDGSAPGDFGFDPLRLGEVPENLERFKESELIHCRWAMLAVPGILVPEALGLGNWVQAQEWAAVPGGQATYLGQPVPWGTLPTILVIEFLAIAFVEHQRSMEKDPEKRKYPGGAFDPLGYSKDPAKFHEYKVKEIKNGRLALLAFVGFCVQQSAYPGTGPLENLATHLADPWHNNIGDIIIPRTLSP

SEQ ID NO: 5151 - protein, 245 aa, Citrus sinensis
MASNTLMSCGIATTAFPSVLSSSKSKFFTAVSLPAAANATSKYAMSADWMPGEPRPPYLDGSAPGDFGFDPLRLGEVPENLERYKESELIHCRWAMLAVPGILVPEALGLGNWVQAQEWAAVPGGQATYLGNPVPWGTLPTILVIEFLSIAFVEHQRSMEKDPEKKKYPGGAFDPLGFSKDPQKFEEYKVKEIKNGRLALLAFVGFCVQQSAYPGTGPLENLATHLADPWHNNIGDVIIPRGIVP

SEQ ID NO: 5152 - protein, 243 aa, Populus trichocarpa
MATNTLMSCGIATAFPSLLSSSKSKFASSIPLPSVNGTSRVTMSADWMPGQPRPPYLDGSAPGDFGFDPLRLGEVPENLERYKESELIHCRWAMLAVPGILVPEALGLGNWVKAQEWAATPGGQATYLGQPVPWGTLPIILAIEFVAIAFVEHQRSMEKDTEKKKYPGGAFDPLGYSKDPQKFEEYKVKEIKNGRLALLAFVGICVQQTAYPGTGPLENLATHLADPWHNNIGDVLIPRSVSP

SEQ ID NO: 5153 - protein, 245 aa, Cleome gynandra
MASNTLMSYGVAAACPSLLSSSKSKFVAGGVSLPIAGGNGGRVSMSADWMPGQPRPPYLDGSAPGDFGFDPLRLGEVPENLERYKESELIHCRWAMLAVPGILVPEALGYGNWVKAQEWAATPGGQATYLGNPVPWGTLPTILVIEFLAIAFVEHQRSMEKDPEKKKYPGGAFDPLGYSKDPKKFEELKVKEIKNGRLALLAFVGFCVQQSAYPGTGPLENLATHLADPWHNNIGDIIIPISLSP

SEQ ID NO: 5154 - protein, 246 aa, Cleome spinosa
MASNALMSCGIAAAYPSLLSSSKSKFVAGGVSLPIAGVNGGGRVSMTADWMPGQPRPPYLDGSAPGDFGFDPLRLGEVPENLERYKESELIHCRWAMLAVPGILVPEALGYGNWVKAQEWAATPGGQATYLGNPVPWGTLPTILVIEFLAIAFVEHQRSMEKDPEKKKYPGGAFDPLGYSKDPKKFEELKVKEIKNGRLALLAFVGFCVQQSAYPGTGPLENLATHLADPWHNNIGDIVIPPSLSP

SEQ ID NO: 5155 - protein, 246 aa, Glycine max
MAANTLMSSAISAFPSLLSSSKSRFAAAVPLSSFVVTNASSSRFSMSADWMPGQPRPPYLDGSAPGDFGFDPLRLGEVPENLERFKESELIHCRWAMLAVPGILVPEALGLGNWVKAQEWAAVPGGQATYLGNPVPWGTLPTILAIEFLAISFVEHQRSMEKDPEKKKYPGGAFDPLGYSKDPKTFHEYKVKEIKNGRLALLAFVGFCVQQSAYPGTGPLENLAAHLADPWHNNIGNVIIPQSILP

SEQ ID NO: 5156 - protein, 246 aa, Glycine max
MAANTLMSTAISAFPSLLSSSKSRFATAVPLSSFGVTNASSSRFSMSADWMPGQPRPPYLDGSAPGDFGFDPLRLGEVPENLERFKESELIHCRWAMLAVPGILVPEALGLGNWVKAQEWAAVPGGQATYLGNPVPWGTLPTILAIEFLAISFVEHQRSMEKDPEKKKYPGGAFDPLGYSKDPKTFHEYKVKELKNGRLALLAFVGFCVQQSAYPGTGPLENLAAHLADPWHNNIGNIIIPQSILP

SEQ ID NO: 5157 - protein, 241 aa, Brassica juncea
MASNSLMSCGIAAVYPSLLSSSKSKFASSGVSLPNVGNVGRVRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5158 - protein, 243 aa, Manihot esculenta
MAANTLMSCGIATAFPSLLSSSKSKFATAIPLPSVNVSSRITMSADWMPGQPRPPYLDGSAPGDFGFDPLRLGEVPENLERFKESELIHCRWAMLAVPGILVPEALGLGNWVQAQEWAAVPGGQATYLGQPVPWGTLPTILVIEFLAIAFVEHQRSMEKDPEKRKYPGGAFDPLGYSKDPAKFHEYKVKEIKNGRLALLAFVGICVQQSAYPGTGPLENLATHLADPWHNNIGDIVIPRSLLP

SEQ ID NO: 5159 - protein, 241 aa, Brassica juncea
MASNSLMSCGIAAVYPSLLSSSKSKFVSSGVSLPNAGNVSRIRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5160 - protein, 241 aa, Brassica juncea
MASNSLMSCGIAAVYPSLLSSSKSKFVSAGVALPNVGNVGRVRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPFN

SEQ ID NO: 5161 - protein, 241 aa, Unknown
  Sequence found in Organisms: Zea mays, Brassica juncea
MASNSLMSCGIAAVYPSLLSSSKSKFVSAGVSLPNVGNVGRIRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5162 - protein, 241 aa, Brassica rapa
MASNSLMSCGIAAVYPSLLSSSKSKFVSAGVALPNVGNVGRVRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5163 - protein, 241 aa, Lotus japonicus
MASNTLMSSAISAFPSLLSSSKSRFATAAPLSCFGTNASSRFSMTADWMPGQPRPPYLDGSAPGDFGFDPLRLGEVPENLERFKESELIHCRWAMLAVPGILVPEALGLGNWVKAQEWAALPGGQATYLGNPVPWGTLPTVLAIEFLAISFVEHQRSMEKDPEKKKYPGGAFDPLGYSKDPKKFHEYKVKEIKNGRLALLAFVGFCVQQSAYPGTGPLENLATHLADPWHNNIGNVLIPPQ

SEQ ID NO: 5164 - protein, 241 aa, Raphanus sativus
MASNSLMSCGIAAVYPSLLSSSKSKFVSAGVALPNAGNVGRVRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDVVIPFN

SEQ ID NO: 5165 - protein, 241 aa, Raphanus sativus
MASNSLMSCGIAAVYPSLLSSSKSKFASSGFALPNAGNVGRIRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5166 - protein, 104 aa, Tragopogon dubius
MASNTLMSCGIPAVGRPSLLSSSKSRFATAVPLSGVATNSSRISMTADWMPGQPRPPYLDGSAPGDFGFDPLRLGEVQKTSKGSKNLNSFTADGLCLHTGDLVT

SEQ ID NO: 5167 - protein, 244 aa, Panax ginseng
MATNALMSCGIAAVFPSVLSSSKSKFAAALPQSLVSANGTTSRYTMTSDWMPGQPRPPYLDGSAPGDFGFDPLGLGSVPENLERFKESELIHCRWAMLAVPGILVPEALGLGNWVQAQEWAAIPGGQATYLGNPVPWGTLPTILVIEFLSIAFVEHQRSMEKDSEKKKYPGGAFDPLGYSKDPKKFEEYKVKEVKNGRLALLAFVGFCVQQSAYPGTGPLENLATHLADPWHNNIGNVLIPRGL

SEQ ID NO: 5168 - protein, 245 aa, Theobroma cacao
MAANTLMSCGIATAFPSVLSSSKSKFAAAVQLPGVGANGSHRVSMSADWMPGQPRPPYLDGSAPGDFGFDPLRLGEVPENLERYKESELIHCRWAMLAVPGILVPEALGYGNWVKAQEWAAIPGGQATYLGNPVPWGTLPIILVIEFFAIAFVEHQRSMEKDTERKKYPGGAFDPLGYSKDPKKFEEYKVKEIKNGRLALLAFVGFCVQQSARPGTGPLENLATHLADPWHNNIGEIIIPRSISP

SEQ ID NO: 5169 - protein, 241 aa, Brassica juncea
MASNSLMSCGIAAVYPSLLSSSKSKFVSAGVALPNAGNVGRIRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5170 - protein, 241 aa, Unknown
  Sequence found in Organisms: Brassica napus, Brassica juncea
MASNSLMSCGIAAVYPSLLSSSKSKFVSSGVALPNVGNVGRVRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5171 - protein, 241 aa, Brassica napus
MASNSLMSCGIAAVYPSLLSSSKSKFVSAGVSLPNVGNVGHIRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5172 - protein, 245 aa, Heritiera littoralis
MAANTVMSCGIATAFPSLLSSSKSKFFAAVPLPCVGANVSHRVRMSADWMPGQPRPPYLDGSAPGDFGFDPLRLGEVPENLERYKESELIHCRWAMLAVPGMLVPEALGYGNWVKAQEWAAIPGGQATYLGNPVPWGNLPTILVIEFLAIAFVEHQRSMEKDTEKKKYPGGAFDPLGYSKDPKRFEEYKVKEIKNGRLALLAFVGFCVQQSAYPGTGPLENLATHLADPWHNNIGDVIIPRSIVP

SEQ ID NO: 5173 - protein, 241 aa, Brassica juncea
MASNSLMSCGIAAVYPSLLSSSKSKFVSSGVALPNVGNVGRVRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPFN

SEQ ID NO: 5174 - protein, 241 aa, Brassica juncea
MASNSLMSCGIAAVYPSLLSSSKSKFVSSGVALPNVGNAGRVRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5175 - protein, 241 aa, Musa acuminata
MASSALRSCAVLFPSLLSSSKSQFVSSVAISCTNGASRFSMSADWMPGQPRPPYLDGSAPGDFGFDPLRLGEVPENLERYKESELIHCRWAMLAVPGILVPEALGLGNWVKAQEWAAIPGGQATYLGNPVPWGTLPTILVIEFFAIAFVEHQRSMEKDPEKKKYPGGAFDPLGYSKDPVKFEEYKVKEIKNGRLALLAFVGFCVQQSAYPGTGPLENLATHLADPWHNNIGDIVIPRSILP

SEQ ID NO: 5176 - protein, 244 aa, Coffea canephora
MAANTLTSCGIAAVSPSVLSSSKSKFATSLALPTSASSSSRFTMSAEWMPGEPRPPYLDGSAPGDFGFDPLRFGEVPENLERYKESELIHCRWAMLAVPGVLVPEALGLGNWVQAQEWAAIPGGQATYLGQPVPWGNLPTILAIEFLAIAFVEHQRSIEKDTEKKKYPGGAFDPLGFSKDPAKFAEYKVKEVKNGRLALLAVVGFAVQQSAYPGTGPLENLAAHLADPWHNNIGNVIIPRSIYP

SEQ ID NO: 5177 - protein, 244 aa, Vitis vinifera
MASTVLRSCGVAAVAPSLLSSSKSKFATSLPLPNAAAGSARVTMSADWMPGQPRPPYLDGSAPGDFGFDPLRLGEVPENLERYKESELIHCRWAMLAVPGVLVPEALGLGNWVQAQEWAAIPGGQATYLGNPVPWGNLPTILAIEFLAIAFVEHQRSMEKDTEKKKYPGGAFDPLGYSKDPVKFEEYKVKEIKNGRLAILAFVGFCVQQSAYPGTGPLENLASHLADPWHNNIGDVIIPRSIMP

SEQ ID NO: 5178 - protein, 244 aa, Cajanus cajan
MATNTLMSSAVTAFPSLLSSSKSKFATAIPLSSFATNASSRFTMTSDWMPGQPRPPYLDGSAPGDFGFDPLRLGEVPENLERFKESELIHCRWAMLAVPGILVPEALGLGNWVKAQEWAAVPGGQATYLGNPVPWGTLPTILVIEFLSIAFVEHQRSMEKDPEKKKYPGGAFDPLGYSKDPKTFHEYKVKEIKNGRLALLAFVGFCVQQSAYPGTGPLENLATHLADPWHNNIGNVIIPQSILP

SEQ ID NO: 5179 - protein, 241 aa, Raphanus sativus
MASNSLMSCGIAAVYPSLLSSSKSKFVSSGFALPNAGNVGRIRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5180 - protein, 241 aa, Arabidopsis lyrata
MASNSLMSCGIAAVYPSLLSSSKSKFVSAGVPLPNAGNVGRIRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKLEELKVKEIKNGRLALLAFVGFCVQQSAYPGTGPLENLATHLADPWHNNIGDIVIPFN

SEQ ID NO: 5181 - protein, 241 aa, Unknown
  Sequence found in Organisms: Brassica napus, Brassica juncea, Brassica rapa
MASNSLMSCGIAAVYPSLLSSSKSKFVSAGVPLPNAGNVGRVRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5182 - protein, 241 aa, Unknown
  Sequence found in Organisms: Brassica napus, Brassica juncea
MASNSLMSCGIAAVYPSLLSSSKSKFVSAGVPLPNAGNVGRIRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5183 - protein, 245 aa, Artemisia annua
MASNTLMSYGIPAVARPSVLSSSKSRFTANVPLFGVVSNGSRLVMTSDWMPGQPRPSYLDGSAPGDFGFDPLRLGEVPENLERFKESELIHCRWAMLAVPGILVPEALGLGNWVKAQEWAALPGGQATYLGNPVPWGTLPTILAIEFISIAFVEHQRSMEKNPEKRKYPGGAFDPLGYSNDPKKFEEYKVKEIKNGRLALLAFVGFCVQQSAYPGTGPLENLATHLADPWHSNIGDVIIPKGFLP

SEQ ID NO: 5184 - protein, 245 aa, Artemisia annua
  misc_feature (12)..(12): Xaa can be any naturally occurring amino acid
  misc_feature (16)..(16): Xaa can be any naturally occurring amino acid
MASNTLMSYGIXAVAXPSVLSSSKSRFTANVPLFGVVSNGSRLVMTSDWMPGQPRPSYLDGSAPGDFGFDPLRLGEVPENLERFKESELIHCRWAMLAVPGILVPEALGLGNWVKAQEWAALPGGQATYLGNPVPWGTLPTILAIEFISIAFVEHQRSMEKNPEKRKYPGGAFDPLGYSSDPKKFEEYKVKEIKNGRLALLAFVGFCVQQSAYPGTGPLENLATHLADPWHSNIGDVIIPKGFLP

SEQ ID NO: 5185 - protein, 241 aa, Brassica oleracea
MASNSLMSCGIAAVYPSLLSSSKSKFVSAGVPLPNAGNVGRIRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPFN

SEQ ID NO: 5186 - protein, 241 aa, Thellungiella halophila
MASNSLMSCGIAAVYPSLLSSSKSKFVSAGVPLPNAGNVGRIRMAAHWMPGEPRPAYLDGSAPGDFGFDPLGLGEVPENLERYKESELIHCRWAMLAVPGILVPEALGYGNWVKAQEWAALPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5187 - protein, 252 aa, Cajanus cajan
MATNTLMSSAVTAFPSLLSSSKSKFATAIPLSSFATNASSRFTMTSDWMPGQPRPPYLDGSAPGDFGFDPLRLGEVPENLERFKESELIHCRWAMLAVPGILVPEALGLGNWVKAQEWAAVPGGQATYLGNPVPWGTLPTILVIEFLSIAFVEHQRSMEKDPEKKKYPGGAFDPLGYSKDPKTFHEYKVKELRMDVLPCWLLWDSVFNNQLIQALDLWRTWLLTWLIHGTTTLEMSLFPNRFCLEKPIQSFF

SEQ ID NO: 5188 - protein, 245 aa, Aquilegia formosa
MASNALRSCGLAAAFPSLLSSSNSKFVTSVALPVGRTNASSGFKMSAEWMPGQPRPPYLDGSAPGDFGFDPLGLGEVPENLERFKESELIHCRWAMLAVPGILLPEALGLGNWVQAQEWAALPGGQATYLGNPVPWGTLPTILAIEFLAIGFVENQRTMEKDPEKKKYPGGAFDPLGYSKDPKKFEEYKVKEIKNGRLALLAFVGFCVQQSAYPGTGPLENLATHLADPWHNNIGNVVIPKGILP

SEQ ID NO: 5189 - protein, 241 aa, Unknown
  Sequence found in Organisms: Brassica napus, Brassica juncea, Brassica oleracea
MASNSLMSCGIAAVYPSLLSSSKSKFVSSGVALPNAGNVGRVRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIGDIVIPLN

SEQ ID NO: 5190 - protein, 243 aa, Manihot esculenta
MAANTLMSCGIATAFPSLLSSSKSKFASSIPLPSVNVSSRITMSADWMPGQPRPPYLDGSAPGDFGFDPLRLGEVPENLERFKESELIHCRWAMLAVPGILVPEALGLGNWVQAQEWAAVPGGQATYLGQPVPWGTLPTILVIEFLAIAFVEHQRSMEKDPEKRKYPGGAFDPLGYSKDPAKFHEYKVKEIKNGRLALLAFVGICVQQSAYPGTGPLENLATHLADPWHNNIGDIVIPRSLLP

SEQ ID NO: 5191 - protein, 244 aa, Vigna unguiculata
MAANTLMSSAITAFPSLLSSSKSRFASAVPISSFATNASSRFSMTADWMPGQPRPPYLDGSAPGDFGFDPLRLGEVPENLERFKESELIHCRWAMLAVPGILVPEALGLGNWVKAQEWAAVPGGQATYLGNPVPWGTLPTILVIEFLAISFVEHQRSMEKDPEKKKYPGGAFDPLGYSKDPKAFHEYKVKELKNGRLALLAFVGFCVQQSAYPGTGPLENLATHLADPWHNNIGNIIIPQSILP

SEQ ID NO: 5192 - protein, 242 aa, Mesembryanthemum crystallinum
MASNALRSCGIAAVFPSSLSSSKSVFATSVPLGNVSCNSSRFTMSAEWMPGQPRPPYLDGSAPGDFGFDPLRLGEVPENLERFKESELIHCRWAMLAVPGIIVPEALGLGNWVKAQEWAAIPGGQATYLGNPVPWGNLPTILAIEFLAIAFVEHQRSMEKDPEKRKYPGGAFDPLGYSKDPKKFEELKIKEVKNGRLALLAFVGFCIQQSAYPGTGPLENLATHLADPWHKNIGDILIPPSM

SEQ ID NO: 5193 - protein, 242 aa, Eucalyptus gunnii
MAANSLMSCGISTTSFPSVLSSSKSKFAAAVPLPSGAATNAASRFSMSADWMPGSPRPPYLDGSAPGDFGFDPLRLGEVPENLERFKESELIHCRWAMLAVPGILVPEALGLGNWVQAQEWAAKPGGQATYLGNPVPWGTLPTILAIEFISIAFVEHQRSMEKDPEKKKYPGGAFDPLGYSKDPVKFEELKVKEIKNGRLALLAFVGFCVQQTAYPGTGPLENLATHLADPWHNNIGDILIP

SEQ ID NO: 5194 - protein, 244 aa, Quercus alba
MAANTLMSCGIATTAFPSVLSSSKSKFATATPLSSVGANASSRFTMSAEWMPGQPRPKHLDGSAPGDFGFDPLGLGEVPENLERFKESELIHCRWCMLAVPGVLVPEALGLGNWVQAQEWAAVPGGQATYLGNPVPWGNLPTILAIEFLAISFVEHQRSMEKDPEKKKYPGGAFDPLGYSKDPKKFEEYKVKEIKNGRLAILAFLGFCVQQSAYPGTGPLENLASHLADPWHNNIGNVIIPRGL

SEQ ID NO: 5195 - protein, 241 aa, Arabidopsis thaliana
MASNSLMSCGIAAVYPSLLSSSKSKFVSAGVPLPNAGNVGRIRMAAHWMPGEPRPAYLDGSAPGDFGFDPLGLGEVPANLERYKESELIHCRWAMLAVPGILVPEALGYGNWVKAQEWAALPGGQATYLGNPVPWGTLPTILAIEFLAIAFVEHQRSMEKDPEKKKYPGGAFDPLGYSKDPKKLEELKVKEIKNGRLALLAFVGFCVQQSAYPGTGPLENLATHLADPWHNNIGDIVIPFN

SEQ ID NO: 5196 - protein, 244 aa, Populus trichocarpa
MAATNTLMSCGIATAFPSLLSSSKSKFASSIPLPSVNGTSRVTMSADWLPGQPRPPYLDGSAPGDFGFDPLRLGEVPENLERYKESELIHCRWAMLAVPGILIPEALGLGNWVKAQEWAAAPGGQATYLGQPVPWGTLPTVLAIEFVAIAFVEHQRSMEKDPEKKKYPGGAFDPLGFSKDPKKFEEYKVKEIKNGRLALLAFVGFCVQQSAYPGTGPLENLATHLADPWHNNIGDIIVPRTLSP

SEQ ID NO: 5197 - protein, 244 aa, Curcuma longa
MASTALRSCAVLFPSLLSSSKSKFAAGSLALPSSHGASVGRFSMSADWMPGQPRPPYLDGSAPGDFGFDPLRLGEVPENLERYKESELIHCRWAMAAVPGILIPEALGLGNWVKAQEWAAIPGGQATYLGNPVPWGTLPTILVIEFLAIAFVEHQRSIEKDPEKKKYPGGAFDPLGYSKDPAKFEEYKVKEIKNGRLALLAFVGICVQQSAYPGTGPLENLASHLADPWHNNIGDIVIPRSIVP

SEQ ID NO: 5198 - protein, 245 aa, Tropaeolum majus
MATNTLMSHGISTPAFPTLLSASKSKFAAAFSLPSTISNGNRFVMSAEWMPGQPRPSYLDGSAPGDFGFDPLGLGAVPENLERFKESELIHCRWAMLAVPGILVPEALGLGNWVQAQEWAAVPGGQATYLGNPVPWGTLPTILAIEFLAIAFVEHQRSMEKDPEKRKYPGGAFDPLGYSKDPKKFEEYKVKEIKNGRLALLAFVGFCVQQSAYPGTGPLENLASHLADPWHNTIGDIVIPRSIYN

SEQ ID NO: 5199 - protein, 244 aa, Quercus alba
MAANTLMSCGIATTAFPSVLSSSKSKFATATPLPSVGANASSRFTMSAEWMPGQPRPKHLDGSAPGDFGFDPLGLGEVPENLERFKESELIHCRWSMLAVPGVLVPEALGLGNWVQAQEWAAVPGGQATYLGNPVPWGNLPTILAIEFLAISFVEHQRSMEKDPEKKKYPGGAFDPLGYSKDPKKFEEYKVKEIKNGRLAILAFLGFCVQQSAYPGTGPLENLASHLADPWHNNIGNVIIPRGL

SEQ ID NO: 5200 - protein, 244 aa, Phaseolus coccineus
MAANTLMSSAITAFPSLLSSSKSRFASSVPISSFGTNASSRFSMTSDWMPGQPRPPYLDGSAPGDFGFDPLGLGEVPENLERFKESELIHCRWAMLAVPGILVPEALGLGNWVKAQEWAAVPGGQATYLGNPVPWGTLPTILVIEFLAISFVEHQRSMEKDPEKKKYPGGAFDPLGYSKDPKSFHEYKVKEIKNGRLALLAFVGICVQQSAYPGTGPLENLATHLADPWHNNIGNIVIPQSISP

SEQ ID NO: 5201 - protein, 245 aa, Liriodendron tulipifera
MASSALRSCGVASVVPSLLSSSKSKFANAIALPNSFSNASSRWAMSAEWMPGQPRPPYLDGSAPGDFGFDPLRLGEVPENLERFKESELIHCRWAMLAVPGILVPEALGLGNWVKAQEWAAVPGGQATYLGNPVPWGTLPTILVIEFIAIAFVEHQRSMEKDTEKKKYPGGAFDPLGYSKDPEKFKEYKIKEIKNGRLALLAFVGFCVQQSAYPGTGPLENLATHLADPWHNNIGDVLIPRNLSP

SEQ ID NO: 5202 - protein, 240 aa, Arachis hypogaea
MASNTLMSSTISAFPSLLSSSKSRFATSIPISCFGSNVSSRFSMTADWMPGQPRPPYLDGSAPGDFGFDPLRLGAVPENLERFKESELIHCRWAMLAVPGMLVPEALGLGNWVQAQEWAAKPGGQATYLGNPVPWGTLPTILVIEFLAIAFVEHQRSMEKDPEKKKYPGGAFDPLGYSKDPKKFHEYKIKEIKNGRLALLAFVGFCVQQSAYPGTGPLENLATHLADPWHNNIGNVIIPF

SEQ ID NO: 5203 - protein, 244 aa, Mimulus guttatus
MAANALMSCGMAAAAVVRPSVLSSSKSRFAASIPMATSGGATTSRFTMSAEWMPGEPRPPYLDGSAPGDFGFDPLGLGEVPANLERYKESELIHCRWAMLAVPGILVPEALGLGNWVKAQEWAALPGGQATYLGNPVPWGTLPTILAIEFLAIAFVEQQRSMEKDPEKKKYPGGAFDPLGYSKDPKKLQELKVKEIKNGRLALLAFVGFCIQQTAYPGTGPLENLATHLADPWHNNIGDVLIPK

SEQ ID NO: 5204 - protein, 234 aa, Brassica napus
MASNSLMSCGIAAVYPSLLSSSKSKFVSAGVPLPNAGNVGRVRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPKKFEELKVKEIKNGRLALLAFVGFCVQQSAYPGTGPLENLATHLADPWHKNIG

SEQ ID NO: 5205 - protein, 240 aa, Arachis hypogaea
MASNTLMSSTISAFPSLLSSSKSRFATSIPISCFGSNVSSRFSMTADWMPGQPRPPYLDGSAPGDFGFDPLRLGAVPENLERFKESELIHCRWAMLAVPGILVPEALGLGNWVQAQEWAAKPGGQATYLGNPVPWGTLPTILVIEFLSIAFVEHQRSMEKDPEKKKYPGGAFDPLGYSKDPKKFHEYKIKEIKNGRLALLAFVGFCVQQSAYPGTGPLENLATHLADPWHNNIGNIIIPF

SEQ ID NO: 5206 - protein, 241 aa, Musa acuminata
MASAALRSCAVLFPSLLSSSKSQFNGSVSLPCANGASRFSMSAEWMPGQPRPPYLDGSAPGDFGFDPLRLGEVPENLERYKESELIHCRWAMLAVPGILVPEALGLGNWVKAQEWAAVPGGQATYLGNPVPWGTLPTILVIEFIAIAFVEHQRSMEKDPEKKKYPGGAFDPLGFSKDPAKFQEYKIKEIKNGRLALLAFVGFCVQQSAYPGTGPLENLATHLADPWHNNIGDIVIPRSVLP

SEQ ID NO: 5207 - protein, 250 aa, Juglans hindsii x Juglans regia
  misc_feature (78)..(78): Xaa can be any naturally occurring amino acid
  misc_feature (156)..(156): Xaa can be any naturally occurring amino acid
REHGFNTLTMSYGIATTTFPSVLSSSKSKFATALPLPGVGAANASSRFTMTAEWMPGQPRPPHLDGSAPGDFGFDPLXLGTVPENLERFKESELIHCRWAMLAVPGILVPEALGLGNWVKAQEWAAVPGGQATYLGYPVPWGTLPTILVIEFLAIXFVEHQRSMEKDPEKKKYPGGAFDPLGYSKDPEKFKEYKVKEIKNGRLALLAFVGFCVQQSAYPGTGPLENLATHLADPWHNNIGDILIPRSVSP

SEQ ID NO: 5208 - protein, 241 aa, Juglans hindsii x Juglans regia
  misc_feature (40)..(40): Xaa can be any naturally occurring amino acid
MSYGIATSTAFPSVLSSSKSKFAAALPLPSVGANASSRFXMSAEWMPGQPRPPHLDGSAPGDFGFDPLGLGAVPENLERFKESELIHCRWAMLAVPGILVPEALGLGNWVQAQEWAAVPGGQATYLGNPVPWGTLPTILVIEFLAIAFVEHQRSMEKDPEKKKYPGGAFDPLGYSKDPEKLKEYKVKEIKNGRLALLAFVGFCVQQSAYPGTGPLENLATHLADPWHNNIGDIIIPRSLYP

SEQ ID NO: 5209 - protein, 247 aa, Carica papaya
MASNSLTSCGVAAAAFPALLSSSKSKFTAAVPLPSATSNGGHGRVVMSADWMPGQPRPPYLDGSAPGDFGFDPLRLGAVPENLERYKESELIHCRWAMLAVPGILVPEALGLGNWVKAQEWAATPGGQATYLGNPVPWGTLPTILVIEFLSIAFVEHQRSMEKDPEKKKYPGGAFDPLGYSKDPKKFEEYKVKEIKNGRLALLAFVGFCVQQTAYPGTGPLENLATHLADPWHNNIGDIVIPRSILP

SEQ ID NO: 5210 - protein, 240 aa, Eschscholzia californica
MASNTLRSCGIATVFPSVLSSSKSKFAASISFPSVYSNGSSRLTMSAEWMPGEPRPPYLDGSAPGDFGFDPLRLGEVPENLERFKESELIHCRWAMLAVPGILVPEALGLGNWVKAQEWAALPDGQATYLGNPVPWGTLPTILVIEFLSIAFVEHQRSMEKDPEKKKYPGGAFDPLGYSKDPVKFKEYKIKEIKNGRLALLAFVGFCVQQSAYPGTGPLENLATHLADPWHNNIGNIVIP

SEQ ID NO: 5211 - protein, 230 aa, Mimulus guttatus
AAVVRPSVLSSSKSRFAASIPMATSGATTSRYTMSAEWMPGEPRPPYLDGSAPGDFGFDPLGLGEVPANLERYKESELIHCRWAMLAVPGILVPEALGLGNWVKAQEWAALPGGQATYLGNPVPWGTLPTILAIEFLAIAFVEHQRSMEKDPEKKKYPGGAFDPLGYSKDPKKLQELKVKEIKNGRLALLAFVGFCIQQTAYPGTGPLENLATHLADPWHNNIGDVLIPK

SEQ ID NO: 5212 - protein, 235 aa, Rosa hybrid cultivar
  misc_feature (71)..(71): Xaa can be any naturally occurring amino acid
  misc_feature (118)..(118): Xaa can be any naturally occurring amino acid
  misc_feature (151)..(151): Xaa can be any naturally occurring amino acid
  misc_feature (181)..(181): Xaa can be any naturally occurring amino acid
MASNTLMSCGIATTAFPSVLSSSKSKFATAVQLPSVGVNASSRFSMSADWMPGQPRPPYLDGSAPGDFGFXPLRLGEVPENLERFKESELIHCRWAMLAVPGILVPEALGLGNWVFAXEWAAIPGGQATYLGNPVPWGTLPTILVIEFLSXAFVEHQRSMEKDPEKKKYPGGAFDPLGYSXDPKKFEEYKVKEIKNGRLALLAFVGFVVQQSAYPGTGPLENLATHLADPWHKHI

SEQ ID NO: 5213 - protein, 242 aa, Medicago truncatula
MACNTLMSSAISAFPSLLSSSKSRFSTSLPLPCTASTNASSRFTMTSDWMPGQPRPSYLDGSAPGDFGFDPLRLGEVPENLERFKESELIHCRWAMLAVPGILVPEALGLGNWVKAQEWAALPGGQATYLGNPVPWGTLPTILVIEFLSIAFVEHQRSMEKDPEKKKYPGGAFDPLGYSKDPKKFHEYKIKEVKNGRLALLAFVGIVVQQTAYPGTGPLENLATHLADPWHNNIGNVLIPPQ

SEQ ID NO: 5214 - protein, 228 aa, Brassica napus
  misc_feature (182)..(182): Xaa can be any naturally occurring amino acid
MASNSLMSCGIAAVYPSLLSSSKSKFVSSGVALPNVGNVGRVRMAAHWMPGEPRPAYLDGSAPGDFGFDPLGLGEVPENLERYKESELIHCRWAMLAVPGILVPEALGYGNWVKAQEWAAVPGGQATYLGNPVPWGTLPTILAIEFLAIAFVEHQRSMEKDPEKKKYPGGAFDPLGYSKDPXKFEELKVKEIKNGRLALLAFVGFCVQQSAYPGTGPLENLATHLADP

SEQ ID NO: 5215 - protein, 230 aa, Acacia harpophylla
MASSTLMSYGIATASSFPSRLSSSKSKFVAAIPLPGVASTSRFTMTADWMPGQPRPPYLDGSAPGDFGFDPLRLGEVPENLERYKESELIHCRWAMLAVPGILVPEALGLGNWVEAQRWAAVPGGQATYLGNPVPWGTLPTILVIEFLAIAFVEHQRSMEKDPEKKKYPGGAFDPLGYSKDPVKFEEYKVKEIKNGRLALLAFVGICVQQSAYPGTGPLENLATHLADPW

SEQ ID NO: 5216 - protein, 242 aa, Amborella trichopoda
MASLGRCCQLAAMPSVLSSTKSAFTPSLSFPSLNSSSSRFTMSAEWMPGQPRPPHLDGSAPGDFGFDPLGLGEVPENLERFKESELIHCRWAMLAVPGILIPEALGLGNWVKAQEWAATPGGQATYLGNPVPWGTLPTILVIEFLSIAFVEHQRSMEKDTEKKKYPGGAFDPLGYSKDPVKFEEYKVKEVKNGRLALLAFVGFCVQQSARPGTGPLENLATHLADPWHNNIGDVIIPRSILP

SEQ ID NO: 5217 - protein, 462 aa, Solanum phureja
MASQPKNVGILAMEIYFPPTCLQQEVLEAHDGASKGKYTIGLGQDCMGFCTEVEDVISMSLTAVNSLLEKYSVDPKQIGRLEVGSETVIDKSKSIKTFLMQIFEKHGNTDIEGVDSTNACYGGTAALFNCVNWVESASWDGRYGLVVCTDSAVYAEGPARPTGGAAAVAMLVGPDAPIVFESKIRASHMSHVYDFYKPILDSEYPVVDGKLSQTCYLMALDACYKSLCNKYEKLEGKQFSMTDAAYFVFHSPYNKLVQKSFSRLLFNDFLRNASSIDESAKKILAPFESLTGDESYQSRDLEKTSQQLAKPLYDEKVQPTTLIPKQVGNMYTASLYAAFASLLHNKHNTLAGQRVIMFSYGSGLTATMFSLKFNEGQHPFSLSNIASVMNVAEKLESRHEFTPEKFIEILKLMEHRYGAKDFVTSKDCSLLAPGTYYLTEVDSKYRRFYAKKAHENGQVNGH

SEQ ID NO: 5218 - protein, 462 aa, Solanum lycopersicum
MAAQRKNVGILAMEIYFPPTCIQQETLEAHDGASKGKYTIGLGQDCMGFCTEVEDVISMSLTAVTSLVEKYAIDPNQVGRLEVGSETVIDKSKSIKTFLMQIFEKCGNTDIEGVDSTNACYGGTAALFNCVNWVESASWDGRYGLVVCTDSAVYAEGPARPTGGAAAIAMLIGPDAPIVFESKIRASHMAHVYDFYKPILDSEYPVVDGKLSQTCYLVALDSCYKILCNKYEKLEGKQFSIADAAYFVFHSPYNKLVQKSFARLVFNDFTRNASSIDESAKEKLAPFSSLSHDESYQSRDLEKASQQVAKPFYDEKVQPTTLIPKQVGNMYTASLYAAFASLLHNKHKTLAGQRVVLFSYGSGSTATMFSLKLNEGQHPFSLSNIASVMNVKEKLESRNELTPEKFVEIMKLMEHRYGAKDFVTSKDCSLLAPGTYYLTEVDSKYRRFYAKKAAENGLANGH

SEQ ID NO: 5219 - protein, 462 aa, Capsicum annuum
MAGQQKNVGILAMEIYFPPTCIQQETLEAHDGASKGKYTIGLGQDCMGFCTEVEDVISMSLTAVTSLLEKYAIDPKQVGRLEVGSETVIDKSKSIKTFLMQIFEKCGNTDIEGVDSTNACYGGTAALFNCVNWVESSSWDGRYGLVVCTDSAVYAEGPARPTGGAAAIAMLIGPDAPIVFESKIRASHMAHVYDFYKPILDSEYPVVDGKLSQTCYLMALDSCYKILCNKYEKLEGKQFSIADAAYFVFHSPYNKLVQKSFARLAFNDFMRNASSIDEYAKATLAPFSSLSGDESYQSRDLEKASQLVAKPFYDEKVQPTTLIPKQVGNMYTASLYAAFASLLHNKHSALAGKRVILFSYGSGSTATMFSVRLNEGQHPFSLSNIASVMNVAEKLKSRNEFTPEKFVEIMKLMEHRYGAKDFVTSKDCSLLALGTYYLTEVDSKYRRFYAKKAAENGLANGH

SEQ ID NO: 5220 - protein, 462 aa, Solanum phureja
MAAQQKNVGILAMEIYFPPTCIQQETMEAHDGASKGKYTIGLGQDCMGFCTEVEDVISMSLTAVSSLLEKYAIDPKKVGRLEVGSETVIDKSKSIKTFLMQIFEKCGNTDIEGVDSTNACYGGTAALFNCVNWVESASWDGRYGLVVCTDSAVYAEGPARPTGGAAAIAMLIGPDAPIVFESKIRASHMAHVYDFYKPILDSEYPVVDGKLSQTCYLVALDSCYKILCNKYEKLEGNQFSIADAAYFVFHSPYNKLVQKSFARLVFNDFTRNASSIDESAKEKLSPFSSLSHDESYQSRDLEKVSQQVAKPFYDEKVQPTTLIPKQVGNMYTASLYAAFASLLHNKHNTLAGQRVVLFSYGSGSTATMFSLKLNEGQHPFSLSNIASVMNVKEKLKSRNELTPEKFVEIMKLMEHRYGAKDFVTSKDCSLLAPGTYYLTEVDSKYRRFYAKKGAENGLANGH

SEQ ID NO: 5221 - protein, 462 aa, Solanum tuberosum
MAAQPKNVGILAVEIYFPPTCLQQEALEAHDGASKGKYTIGLGQDCMGFCTEVEDVISMSLTAVTSLLEKYAIDPKQIGRLEVGSETVIDKSKSIKTFLMQIFETCGNTDIEGVDSTNACYGGTAALFNCVNWVESSSWDGRYGLVVCTDSAVYAEGAARPTGGAAAIAMLVGPDAPIVFESKIRASHMAHVYDFYKPILDSEYPVVDGKLSQTCYLMALDSCYKSLCNKYEKLEGKQFSIDDAAYFVFHSPYNKLVQKSTARLMFNDFTRNASSIDESTKEKLAPFSSLTGDESYQSRDLEKTSWQVAKPFYDEKVKPTTLVPKQVGNMYTASLYAAFASLLHNKHSSLAGQRVVLFSYGSGLTATMFSLKLHEGQHPFNLSNIAVVMNVEEKLKSRHEFTPENFIETMKIMEHRYGGKDFVTSKDCSLLAPGTYYLTEVDSKYRRFYAKKCTENGLANGH

SEQ ID NO: 5222 - protein, 462 aa, Solanum lycopersicum
MAAQPKNVGILAVEIYFPPTCLQQEALEAHDGASKGKYTIGLGQDCMGFCTEVEDVISMSLTAVTSLLEKYAIDPKQIGRLEVGSETVIDKSKSIKTFLMQIFEKSGNTDIEGVDSTNACYGGTAALFNCVNWVESSSWDGRYGLVVCTDSAVYAEGAARPTGGAAAIAMLVGPDAPIVFESKIRASHMAHVYDFYKPILDSEYPVVDGKLSQTCYLMALDSCYKSLCNKYEKLEGKQFSIDDAAYFVFHSPYNKLVQKSTARLMFNDFTRNASSIDESTKEKLAPFSSLTGDESYQSRDLEKTSWQVAKPFYDEKVKPATLIPKQVGNMYTASLYAAFASLLHNKHSSLAGQRVVLFSYGSGLTATMFSLKLHEGQHPFNLSNIATVMNIEEKLKSRHEFTPENFIETMKIMEHRYGGKDFVTSKDCSLLAPGTYYLTEVDSKYRRFYAKKCAENGLANGH

SEQ ID NO: 5223 - protein, 462 aa, Solanum phureja
MAAQPKNVGILAVEIYFPPTCLQQEALEAHDGASKGKYTIGLGQDCMGFCTEVEDVISMSLTAVTSLLEKYAIDPKQIGRLEVGSETVIDKSKSIKTFLMQIFETCGNTDIEGVDSTNACYGGTAALFNCVNWVESSSWDGRYGLVVCTDSAVYAEGAARPTGGAAAIAMLVGPDAPIVFESKIRASHMAHVYDFYKPILDSEYPVVDGKLSQTCYLMALDSCYKSLCNKYEKLDGKQFSIDDAAYFVFHSPYNKLVQKSTARLMFNDFTRNASSIDESTKEKLAPFSSLTGDESYQSRDLEKTSWQVAKPFYDKKVKPTTLVPKQVGNMYTASLYAAFASLLHNKHSSLAGQRVVLFSYGSGLTATMFSLKLHEGQHPFNLSNIAVVMNVEEKLKSRHEFTPENFIETMKIMEHRYGGKDFVTSKDCSLLAPGTYYLTEVDSKYRRFYAKKCTENGLANGH

SEQ ID NO: 5224 - protein, 460 aa, Triphysaria pusilla
MAKNVGILAMEIYFPPTCIQQEVLEAHDGASKGKYTIGLGQDCMAFCDEVEDVISMSMTAVTSLLEKYGVDPKQIGRLEVGSETVLDKSKSIKTFLMPIFEKCGNTDIEGVDSTNACYGGTAALFNCVNWVESSSWDGRYGLVVCTDSAVYAEGPARPTGGAAAVAMLIGPNAPISFESKLRASHMSHVYDFYKPDLASEYPVVDGKLSQTCYLMALDSCYKSLCDKYKKQEGKQFSVSDAEYFVFHSPYNKLVQKSFARLLYNDFLSSASSIDEAAKEKMAPFSSLTIDESYQSRDLEKVSQQVAKPFYDAKVQPSTLIPKQVGNMYTASLYAAFASLLHNKNSTLAGQRVILFSYGSGLSATIFSLRFNEGQHPFSLSNIASVMNVSEKLKSRHEFAPEKFVEIMKLMEHRYGNKDFVTSKDCSLLASGTFYLTEVDSKYRRFYARKAAENGVTPNSN

SEQ ID NO: 5225 - protein, 465 aa, Gossypium hirsutum
MAKNVGILAMEIYFPPTCVQQEALEAHDGASKGKYTIGLGQDCMAFCTEVEDVISMSLTAVTSLLAKYKIDPKQIGRLEVGSETVIDKSKSIKTFLMQIFEKSGNTDIEGVDSTNACYGGTAALFNCVNWVESSSWDGRYGLVVCTDSAVYAEGPARPTGGAAAIAMLIGPDAPIAFESKLRGSHMSHAYDFYKPNLASEYPVVDGKLSQTCYLMALDTCYKYFCHKYEKLEGKQFSLSDAAYFVFHSPYNKLVQKSFSRLLFNDFLRNASSVDEITKEKLAPFSTLTGDESYQSRDLEKASQQASKSLYDAKVQPTTLIPKQVGNMYTASLYAAFASLIHIKHSELAGKRVILFSYGSGLTATMFSLRFHEGQHPFSLSNIASVMNVGGKLKSRHEFPPEKFVETMKLMEHRYGAKDFVTSKDCSLLSPGTYYLTEVDSMYRRFYAKKDGDFAACDNGSIANGH

SEQ ID NO: 5226 - protein, 460 aa, Triphysaria pusilla
MAKNVGILAMEIYFPPTCIQQEVLEAHDGASKGKYTIGLGQDCMAFCDDVEDVISMSMTAVTSLLEKYDVDPKQIGRLEVGSETVLDKSKSIKTFLMPIFEKCGNTDIEGVDSTNACYGGTAALFNCVNWVESSSWDGRYGLVVCTDSAVYAEGPARPTGGAAAVAMLIGPNAPISFEGKLRASHMSHVYDFYKPDLASEYPVVDGKLSQTCYLMALDSCYKILCDKYKKQEGKQFSVDEAAYFVFHSPYNKLVQKSFARLLFNDFLSSASSIDEAAKEKLAPFSSLTMDESYQSRDLEKASQQVAKPFFDTKVQPSTLIPKQVGNMYTASLYAAFASLLHNKNSTLAGQRVILFSYGSGLSATMFSLRFNEGQHPFSLSNIAAVMNVSEKLKARHEFAPEKFVEIMKVMEHRYGNKDFVTSKDYSLLAPGTYYLTEVDSKYRRFYARKASENGVTANGH

SEQ ID NO: 5227 - protein, 465 aa, Theobroma cacao
  misc_feature (125)..(125): Xaa can be any naturally occurring amino acid
MAKNVGILAMDIYFPPTCVRQEALEAHDGASKGKYTIGLGQDCMAFCTEVEDVISMSLTVVTSLLEKYKIDPKQIGRLEVGSETVIDKSKSIKTFLMQIFEKCGNTDIEGVDSTNACYGGTAALXNCVNWVESSSWDGRYGLVVCTDSAVYAEGPARPTGGAAAIAMLVGPDAPIAFESKLRGSHMSHVYDFYKPNLASEYPVVDGKLSQTCYLMALDSCYKYFCHKYEKLVGKQFSLSDAEYFVFHSPYNKLVQKSFSRLLFNDFLRNASSVDDIAKEKLGPFSTLTGDESYQSRDLEKASQQVSKPLYDAKVQPTTLIPKQVGNMYTASLYAAFVSLIHNKHSELAGKRVILFSYGSGLTATMFSLRLNEGQHPFSLSNIATVMNVAGKLKSRHEFPPEKFVETMKLMEHRYGAKDFVTSKDCSLLSPGTYYLTEVDSMYRRFYAKKDGDFTACENGSLSNGH

SEQ ID NO: 5228 - protein, 461 aa, Mimulus guttatus
MAKNVGILAMEVYFPPTCIQQEVLEAHDGASKGKYTIGLGQDCMAFCDEVEDVISMSMTAVTSLLEKYGVDPKQIGRLEVGSETVLDKSKSIKTFLMPIFEKCGNTDIEGVDSTNACYGGTAALFNCINWVESNSWDGRYGLVVCTDSAVYAEGPARPTGGAAAIAMLVGPDAPIAFESKLRASHMSHVYDFYKPDLASEYPVVDGKLSQTCYLMALDSCYKSLCDKYEKMEGKQFSINDADYFVFHSPYNKLVQKSFSRLLFNDFTRAASSIDEAAKEKLSPFSSLSNDESYQSRDLEKASQQVAKPFYDAKVQPSTLIPKQVGNMYTASIYAAFASLLHNKNTTLAGQRVILFSYGSGLAATMFSVRINEGQHPFSLSNIAAIMNVSDKLKKRHEFPPEKFADIMKLMEHRYGGKDFVTTKDCSLLAPGTYYLTEVDSKYRRFYARKPVENGTAITNGH

SEQ ID NO: 5229 - protein, 465 aa, Manihot esculenta
MAKNVGILAVDIYFPPTCVNQEALEAHDGASKGKYTIGLGQDCMAFCTEVEDVISMSLTAVASLLDKYDIDPKQIGRLEVGSETVIDKSKSIKTFLMQIFEKHGNTDIEGVDSTNACYGGTAALFNCVNWVESSSWDGRYGLVVCTDSAVYAEGPARPTGGAAAIAMLIGPDAPIAFESKFRGSHMSHAYDFYKPNLASEYPVVDGKLSQTCYLMALDSCYKHFCAKYEKLEGKQFSISDAEYFVFHSPYNKLVQKSFGRLVFNDFVRNASSIDETAKEKLAPFSTLSGDESYQNRDLEKASQQVAKALYDAKVQPTTLIPKQVGNMYTASLYAAFASLLHNKHTELAGKRVILFSYGSGLTATMFSLRLNEGQHPFSLSNIASVMNVAGKLKARHEFAPEKFVDILKLMEHRYGAKDFVTSKDCSLLASGTYYLTEVDTMYRRFYAQKAVGNTVENGSLANGHS

SEQ ID NO: 5230 - protein, 273 aa, Catharanthus roseus
MPMIFTSLTLPVNTQLWMASFHKLVTLWHLIRAYKTFCRKYEKFEGKQFSITDASYFVFHSPYNKLVQKSFARLCFIDFLRNASSIDEAAKEKLAPFSSLTGDESYQSRDLEKVSQQVAKPLYDEKVQPTTLIPKQVGNMYTASLYAAFASLIHNKHSTLAGQRVILFSYGSGLTATMFSLRLRECRTPFSLSNIASVMNVAEKLKSRHEFPPEKFVETMHLMEQRYGGKDFVTSKDCSLLAPGTYYLTEVDSMYRRFYAKKAMENGSLANGH

SEQ ID NO: 5231 - protein, 461 aa, Mimulus guttatus
MAKNVGILAMEVYFPPTCIQQEVLEAHDGASKGKYTIGLGQDCMAFCDEVEDVISMSMTAVTSLLEKYGVDPKQIGRLEVGSETVLDKSKSIKTFLMPIFEKCGNTDIEGVDSTNACYGGTAALFNCINWVESNSWDGRYGLVVCTDSAVYAEGPARPTGGAAAIAMLVGPDAPIAFESKLRASHMSHVYDFYKPDLASEYPVVDGKLSQTCYLMALDSCYKSLCDKYEKMEGKQFSINDADYFVFHSPYNKLVQKSFSRLLFNDFTRGASSIDEAAKEKLSPFSSLSNDESYQSRDLEKASQQVAKPFYDAKVQPSTLIPKQVGNMYTASIYAAFASLLHNKNTTLAGQRVILFSYGSGLAATMFSVRINEGQHPFSLSNIEAIMNVSDKLKKRHEFPPEKFADIMKLMEHRYGGKDFVTTKDCSLLAPGTYYLTEVDSKYRRFYARKPVENGTAITNGH

SEQ ID NO: 5232 - protein, 460 aa, Salvia sclarea
MAKNVGILAMEIYFPPTCIQQEVLEAHDGASKGKYTIGLGQDCMAFCSEVEDVISMSMTAVTSLLGKYNVDPKQIGRLEVGSETVLDKSKSIKTFLMPIFEKCGNIDIEGVDSSNACYGGTAALFNCVNWVESSSWDGRYGLVVCTDSAVYAEGPARPTGGAAAIAMLIGPNAPIAFESKLRANHMAHVYDFYKPDLASEYPVVDGKLSQTCYLMALDACYKGFCQKFEKQEGKQFSILDADYFVFHSPYNKLVQKSFSRLLFNDFSRNASSIDEAAKEKLAPFSSLSNEESYQSRDLEKASQQVAKPFFDTKVQPSTLVPKQVGNMYTASLYAAFASLIHNKSSTLAGQRVILFSYGSGLSATMFSLRFTEGEHPFSLSNIASVMNVSEKLKSRHEFPPEKFVELMQLMEHRYGGKDFITSKDCSLLAPGTYYLTEVDSKYRRFYAKKAIANGTVANGH

SEQ ID NO: 5233 - protein, 438 aa, Solanum lycopersicum
EALEAHDGASKGKYTIGLGQDCMGFCTEVEDVISMSLTAVTSLLEKYAIDPKQIGRLEVGSETVIDKSKSIKTFLMQIFEKSGNTDIEGVDSTNACYGGTAALFNCVNWVESSSWDGRYGLVVCTDSAVYAEGAARPTGGAAAIAMLVGPDAPIVFESKIRASHMAHVYDFYKPILDSEYPVVDGKLSQTCYLMALDSCYKSLCNKYEKLEGKQFSIDDAAYFVFHSPYNKLVQKSTARLMFNDFTRNASSIDESTKEKLAPFSSLTGDESYQSRDLEKTSWQVAKPFYDEKVKPATLIPKQVGNMYTASLYAAFASLLHNKHSSLAGQRVVLFSYGSGLTATMFSLKLHEGQHPFNLSNIATVMNIEEKLKSRHEFTPENFIETMKIMEHRYGGKDFVTSKDCSLLAPGTYYLTEVDSKYRRFYAKKCAENGLANGH

SEQ ID NO: 5234 - protein, 464 aa, Ricinus communis
MAKNVGILALDIYFPPTCVQQEALEAHDGASKGKYTIGLGQDCMGFCTEVEDVISMSLTAVTSLLDNYNIDPKQIGRLEVGSETVIDKSKSIKTFLMQIFEKHGNTDIEGVDSSNACYGGTAALFNCVNWVESSSWDGRYGLVVCTDSAVYAEGPARPTGGAAAIAMLIGPDAPIAFESKYRGSHMSHAYDFYKPNLASEYPVVDGKLSQTCYLMALDSCYKHFCAKYEKFEGKQFSISDAEYFVFHSPYNKLVQKSFARLVFNDFVRNASSIDEAAKEKLAPFSTLTGDESYQNRDLEKVSQQVAKPLYDAKVQPTTLIPKQVGNMYTASLYAAFASLLHNKNSKLAGKRVILFSYGSGLTATMFSLRLHEGQHPFSLSNIATVMNVTDKLKSRHEFSPEKFVETMKLMEHRYGAKDFVTSQDCSLLAPGTYYLTEVDTMYRRFYAKKLVDNTCENGLIADGH

SEQ ID NO: 5235 - protein, 464 aa, Populus trichocarpa
MAKNVGILAVDIYFPPTCVQQEALEAHDGASKGKYTIGLGQDCMGFCTEVEDVISMSLTAVSSLLEKYNVDPKQIGRLEVGSETVIDKSKSIKTFLMQIFEKCGNTDIEGVDSTNACYGGTAALFNCVNWVESCSWDGRYGLVVCTDSAVYAEGPARPTGGAAAIAMLVGPDAPITFESKFRGSHMSHVYDFYKPNLASEYPVVDGKLSQTCYLMALDSCYKQFCAKYEKSTGKQFSISDAAYFVFHSPYNKLVQKSFARLVFDDSVRNASSIDEAAKEKLAPFSTLSGDESYQNRDLEKVSQQVAKPLYDAKVQPTTLIPKQVGNMYTASLYAAFVSLLHNKSSELAGKRVILFSYGSGSTATMFSLKLHEGQKPFSLSNIATVMNVSTKLKSRHEFSAVKFVETINLMEHRYGGKDFVTSKDCSLLAPGTYYLTEVDSMYRRFYAKKPVDGACENGSLVNGH

SEQ ID NO: 5236 - protein, 464 aa, Populus trichocarpa
MAKNVGILAVDIYFPPTCVQQEALEAHDGASKGKYTIGLGQDCMGFCTEVEDVISMSLTVVSSLLEKYNVDPKQIGRLEVGSETVIDKSKSIKTFLMQIFEKCGNTDIEGVDSTNACYGGTAALFNCVNWVESCSWDGRYGLVVCTDSAVYAEGPARPTGGAAAIAMLVGPDAPITFESKFRGSHMSHVYDFYKPNLASEYPVVDGKLSQTCYLMALDSCYKQFCAKYEKSTGKQFSISDAAYFVFHSPYNKLVQKSFARLVFDDSVRNASSIDEAAKEKLAPFSTLSGDESYQNRDLEKVSQQVAKPLYDAKVQPTTLIPKQVGNMYTASLYAAFISLLHNKSSELAGKRVILFSYGSGSTATMFSLKLHEGQKPFSLSNIATVMNVSTKLKSRHEFSAVKFVETINLMEHRYGGKDFVTSKDCSLLAPGTYYLTEVDSMYRRFYAKKPVDGACENGSLVNGH

SEQ ID NO: 5237 - protein, 398 aa, Gossypium hirsutum
MAKNVGILAMDIYFPPTCVQQEALEAHDGASKGKYTIGLGQDCMAFCTEVEDVISMSLTAVTSLLAKYKIDPKQIGRLEVGSETVIDKSKSIKTFLMQIFEKSGNTDIEGVDSTNACYGGTAALFNCVNWVESSSWDGRYGLVVCTDSAVYAEGPARPTGGAAAIAMLIGPDAPIAFESKLRGSHMSHAYDFYKPNLASEYPVVDGKLSQTCYLMALDTCYKYFCHKYEKLEGKQFSLSDAAYFVFHSPYNKLVQKSFSRLLFNDFLRNASSVDEITKEKLAPFSTLTGDESYQSRDLEKASQQASKSLYDAKVQPTTLIPKQVGNMYTASLYAAFASLIHNKNSELAGKRVILFSYGSGLTATIFSLRFHEGQHPFSLSNIASVMNVAGKLKSRLSP

SEQ ID NO: 5238 - protein, 464 aa, Populus trichocarpa
MTKNVGILAIDIYFPPTCVQQEALETHDGASKGKYTIGLGQDCLGFCTEVEDVISMSLTVVSSLLEKYNVDPKQIGRLEVGSETVIDKSKSIKTFLMQIFEKCGNTDIEGVDSTNACYGGTAALFNCVNWVESSSWDGRYGLVVCTDSAVYAEGPARPTGGAAAIAMLIGPDAPIVFESKFRGSHMSHVYDFYKPNLASEYPVVDGKLSQTCYLMALDSCYKTFCAKYEKSTGKQFSLSDAAYFVFHSPYNKLVQKSFARLVFNDSVRKASSIDEGAKEKLAPFSTLSGDESYQSRDLEKVSQQVAKPLFEAKVQPTTLIPKQVGNMYTASLYAAFASLLHNKNSELAGKRVILFSYGSGLTATMFSLQLHEGQQPFSLSNIATVMNVPTKLKSRHEFSPEKFVETMHLMEHRYGAKDFVTSKDCSLLAPGTYYLTEVDYMYRRFYAKKPIDGASENCSLTNGH

SEQ ID NO: 5239 - protein, 471 aa, Actinidia deliciosa
MASQPKNVGILAMEIYFPPTCVQQEAMEVHDGASKGKYTIGLGQDCMAFCTEVEDVISMSLTAVTSLLEKYGIDPAQIGRLEVGSETVIDKSKSIKTFLMQIFEESGNTDIEGVDSTNACYGGTAALFNCVNWVESSSWDGRYGLVVCTDSAVYAEGPARPTGGAAAIVMLIGPDAPIAFESKFRGSHMSHVYDFYKPDLASEYPVVDGKLSQTCYLMALDSCYKRFCHKYEKLEGKQFSVVDADYFVFHSPYNKLVQKSFARLLFNDFSRNASSIDEAAKQKLAPFSTLTGDESYQSRDLEKATQQVAKPFYDTKVQPATWVPKQVGNMYTASLYAAFVSLIHNKHSSLAGQRVVMFSYGSGLSATMFSFQIREGQHPFSLSNIATVMNVGGKMKSRHEFPPEKFVETMKLMEHRYGAKDFVTSKDCSLLSPGAYYLTEVDSMYRRFYAKKAGAITTSTGCENGSVANGH

SEQ ID NO: 5240 - protein, 266 aa, Gossypium hirsutum
MAKNVGILAMDIYFPPTFVQQEALEAHDGVSKGKYTIGLGQDCLAFCTEVEDVISMSLTVVTSLLEKYKIDPKQIGRLEVGSETVIDKSKSIKTFLMQIFEKCGNTDIEGVDSTNACYGGTAALFNCVNWVESSSWDGRYGIVVCTDSAVYAEGPARPTGGAAAIAMLIGPDAPIAFESKFRGSHMSHAYDFYKPNLASEYPVVDGKLSQTCYLMALDTCYKYFCHKYEKQEGKQFSLSDADYFVFHSPYNKLVQKALLVWCSMTL

SEQ ID NO: 5241 - protein, 472 aa, Actinidia deliciosa
MASQPKNVGILAMEIYFPPTCVQQEEMEVHDGASKGKYTIGLGQDCMAFCTDVEDVISMSLTVVTSLLEKYGVDPAQIGRLEVGSETVIDKSKSIKTFLMQIFEESGNTDIEGVDSTNACYGGTAALLNCVNWVESCSWDGRYGLVVCTDSAVYAEGPARPTGGAAAIAMLIGPDAPIAFESKFRGSHMSHVYDFYKPNLASEYPVVDGKLSQTCYLMALDSCYKRFCHKYEKLEGKQFSVVDADYFVFHSPYNKLVQKSFARLLFNDFSRNASSVDEAAKEKLAPFSTLTGDESYQSRDLEKATQQVAKPFYDAKVKPATLVPKQVGNMYTASLYAAFVSLIHNKHTSLAGQRVVMFSYGSGLSATMFSFQIREGQHPFSLSNIATVMNVGGKMKSRHEFPPEKFVETMKLMEHRYGAKDFVTSKDCSLLAPGTYYLTEVDSMYRRFYTKKAGTDTTNTGCENGSVANGHC

SEQ ID NO: 5242 - protein, 465 aa, Citrus sinensis
MAKNVGILAMDIYFPPTCVQQEALEAHDGASKGKYTIGLGQECMAFCSEVEDVISMSLTAVTNLLEKYKIDPKQIGRLEVGSETVIDKSKSIKTFLMQIFEKFGNTDIEGVDSTNACYGGTAALFNCVNWVESSSWDGRYGLVVCTDSAVYAEGPARPTGGAAAVVMLVGPDAPVAFESKLRGSHMSHAYDFYKPNLASEYPVVDGKLSQTCYLMALDTCYKCLCSKYEKLEGKQFSLSNADYFMFHSPYNKLVQKSFARLLFNDFMRNASSVDEAAKEKLGPFSTLSGDESYQSRDLEKVSQQLAKPLYDAKVQPSTLIPKQVGNMYTASLYAALASLIHNKHSELDGKRVVLFSYGSGLTATMFSLKLSEGHHPFSLSNILSVMNVAGKLKSRHEFPPEKFVEVMKLMEHRYGAKDFVTSKDSSLLAPGTYYLTEVDSMYRRFYAKKPADVTNCENGSLANGH

SEQ ID NO: 5243 - protein, 461 aa, Fragaria vesca
  misc_feature (451)..(451): Xaa can be any naturally occurring amino acid
MAKNVGILAVDIYFPPSCIQQEALEAHDGASKGKYTIGLGQDCMAFCSEVEDVISMSLTVVTNLLEKYGVDPKQIGRLEVGSETVIDKSKSIKTFLMQIFEKHGNTDIEGVDSTNACYGGTAALFNCVNWVESSSWDGRYGLVVCTDSAVYAEGPARPTGGAAAIAMLIGPDAPIAFESKIRGSHMSHVYDFYKPDLASEYPVVDGKLSQTCYLMALDSCYKQLCKKYEKIEGKQFSISDAEYFVFHSPYNKLVQKSFARLVFQDSLRNACSIDEAAKEKFAPFASLSSDESYASRDLEKVAQQVAKPLYDAKVQPTTLVPKQVGNMYTASLYAAFASLLHNKHDSLDGKRVILFSYGSGSTATMFSLQLRAGQHPFSLKNIAAVMNVGEKLESRHEFAPEKFCEIMKIMEHRYGGKDFVTNKDISLLLPGTFYLTEVDSKYRRFYAQKDXAENGVVANGH

SEQ ID NO: 5244 - protein, 465 aa, Gossypium hirsutum
MAKNVGVLAMEIYFPPTCVQQEALETRDGASKGKYTIGLGQDCMAFCTEVEDVISMSLTAVTSLLEKYTIDPKQIGRFEVGSETVIDKSKSIKTFLMQIFEKCGNTDIEGVDSTNACYGGTAALFNCVNWVESSSWDGRYGLVVCTDSAVYAEGPARPTGGAAAIAMLVGPDAPIVFESKFRGSHMSHAYDFYKPNLASEYPVVDGKLSQTCYLMALDTCYKYFCYKYEKLEGKQFSISDADYIVFHSPYNKLVQKSFARLLFNDFMRNASSVDDIAKEKLSPFSNLTGDESYQSRDLEKVSQQVSKSLYDAKVQPTTLIPKQVGNMYTASLYAAFASLIHNKHSELAGKRVILFSYGSGLTSTMFSLRLHEGQHPFSLSNIATVMNVAGKLKWRHEFPPEKFVQTMKLMEHRYGAKDFVTSKDCGLLSPGTYYLTEVDSMYRRFYSKKDGDYTVCENGSLANGH

SEQ ID NO: 5245 - protein, 465 aa, Cucumis melo
MANNVGILAIDIYFPPTYVQQEALEAHDGASKGKYTIGLGQDCMAFCTEVEDVISMSLTVVNSLLEKYGIDPKQIGRLEVGSETVIDKSKSIKTFLMQIFEKHGNTDIEGVDSTNACYGGTAALFNCVNWVESSSWDGRYGLVVCTDSAVYAEGPARPTGGAAAIAMLIGPDAPIAFESKLRGSHMSHVYDFYKPNLASEYPVVDGKLSQTCYLMALDSCYKQLCHKYEKLEGKQFSISNADYFVFHSPYNKLVQKSFARLLFNDFKRNASSIDVAAKEKLAPFSALSNDESYQSRDLEKITQQLAKPLYDAKVQPSTLIPKQVGNMYTASLYAAFISLLHNKNNSLVGNRVVLFSYGSGSTATMFSLKLNEGQNPFSLSNISAILNVDKKLKSRHELVPEKFVEIMQLMEHRYGAKDFVTSKDCSLLSTGTYYLTEVDSLYRRFYAKKEGGSEKIENGVVANGH

SEQ ID NO: 5246 - protein, 465 aa, Gossypium hirsutum
MAKNVGIIAMDIYFPPTFVQQEALEAHDGVSKGKYTIGLGQDCLAFCTEVEDVISMSLTVVTSLLEKYKIDPKQIGRLEVGSETVIDKSKSIKTFLMQIFEKCGNTDIEGVDSTNACYGGTAALFNCVNWVESSSWDGRYGIVVCTDSAVYAEGPARPTGGAAAIAMLIGPDAPIAFESKFRGSHMSHAYDFYKPNLASEYPVVDGKLSQTCYLMALDTCYKYFCHKYEKQEGKQFSLSDADYFVFHSPYNKLVQKSFARLVFNDFVRNASSVDDIAKEKLAPFSTLTGDESYQSRDLEKASQQVSKPLYDAKVQPTTLIPKQVGNMYTASLYAAFASLLHNKNSELAGKRVILFSYGSGLTATMFSLRLHEGQHPFSLSNIATVMNIAGKLKSRHEFAPEKFVETMHLMEHRYGDKDFVTSKDCSLLSPGTYYLTEVDSKYRRFYAKKDGNCTGNENGSVVNGH

SEQ ID NO: 5247 - protein, 466 aa, Cucumis sativus
MANNVGILAIDIYFPPTYVQQEALEAHDGASKGKYTIGLGQDCMAFCTEVEDVISMSLTVVNSLLEKYGIDPKQIGRLEVGSETVIDKSKSIKTFLMQIFEKHGNTDIEGVDSTNACYGGTAALFNCVNWVESSSWDGRYGLVVCTDSAVYAEGPARPTGGAAAIAMLIGPDAPIAFESKLRGSHMSHVYDFYKPNLASEYPVVDGKLSQTCYLMALDSCYKQLCHKYEKLEGGKQFSLSNADYFVFHSPYNKLVQKSFARLLFNDFKRNASSIDEAAKEKLAPFSTLSNDESYQSRDLEKITQQLAKPLYDAKVQPSTLIPKQVGNMYTASLYAAFISLLHNKNKSLVGNRVVLFSYGSGSTATMFSLKLNEGQNPFSLSNISAILNVDKKLKSRHELVPEKFVEIMQLMEHRYGAKDFVTSKDCSLLSSGTYYLTEVDSLYRRFYAKKEGGSEKIENGVVANGH

SEQ ID NO: 5248 - protein, 468 aa, Castanea mollissima
MAKNVGILAMDIYFPPTCIQQEVLEAHDGASKGKYTIGLGQDCMAFCTEVEDVISMSLTVVTSLLEKYGVDPKQIGRLEVGSETVIDKSKSIKTFLMGIFEKCGNTDIEGVDSTNACYGGTAALLNCVNWVESSSWDGRYGLVVCTDSAVYAEGPARPTGGAAAIAILIGPDAPISFESKVRGSHMAHVYDFYKPNLASEYPVVDGKLSQTCYLIALDSCYKQMCNKYEKLEGKQFSLSDADYFVFHSPYNKLVQKSFARLLYDDFLRNASSIDEAAKEKLAPFLTLSGDESYQSRDLEKVTQQLAKSLYDAKVQPTTLIPKQVGNMYTASLYAAFASLLHNKNSALVGKRVILFSYGSGSSATMFSLQLREGQHPFSLSNIANVMDVARKLKSRHEFPPEKFVETMHLMEQRYGAKDFVTSQDISLLSPGTYYLTEVDSKYRRFYAKKAGDYTTGTACKNGSLVNGL

SEQ ID NO: 5249 - protein, 467 aa, Cajanus cajan
MAKNVGILAIDIYFPPACVQQAALETHDGVSKGKYTIGLGQDCMSFCTEVEDVISMSLTVVTSLLEKYEIDPKQIGRLEVGSETVIDKSKSIKTFLMQIFEKYGNTDIEGVDSTNACYGGTAALFNCVNWVESNSWDGRYGLVVCTDSAVYAEGPARPTGGAAAIAMLIGPDAPISFESKLRGSHMSHAYDFYKPNLASEYPVVDGKLSQTCYLMALDSCYKHLCHKYEKFEGKQFSLSDAEYFVFHSPYNKLVQKSFARLFFDDFLRNASSVDEVAREKLGPFATLSGDESYQSRDLEKASQQVAKPLYDEKVQPTTLIPKQVGNMYTASLYAAFASLIHNKHSTLAGNRVILFSYGSGLTATMFSLRFQDGEGPFSLSNIARVMNVDGKLKSRHEVHPEEFIETLKLMEHRYGAKEFVTSKNDSLLSPGTFYLTEVDSMYRRFYATKARESSLTSAVNGLVANGH

SEQ ID NO: 5250 - protein, 468 aa, Quercus alba
MAKNVGILAMDIYFPLTCIQQEVLEAHDGASKGKYTIGLGQDCMAFCTEVEDVISMSLTVVTSLLEKYGVDPKQIGRLEVGSETVIDKSKSIKTFLMGIFEKCGNTDIEGVDSTNACYGGTAALFNCVNWVESSSWDGRYGLVVCTDSAVYAEGPARPTGGAAAIAILIGPDAPISFESKVRGSHMAHVYDFYKPNLASEYPVVDGKLSQTCYLMALDSCYKQMCNKYEKLEGKQFSLSDADYFVFHSPYNKLVQKSFARLLYDDFLRNASSIDEAAKEKLGPFSTLSGDESYKSRDLEKVTQQLAKSLYDAKVQPTTLLPKQVGNMYTASLYAAFASLIHNKNSALAGKRVILFSYGSGSSATMFSLQLREGQHPFSLSNIANVMDVARKLKSRHEFPPDKFVETMHLMEHRYGAKDFVTSKDISLLSPGTYYLTEVDSMYRRFYAKKDGDSTTGTPCENGSLVNGQ

SEQ ID NO: 5251 - protein, 464 aa, Vitis vinifera
MTKNVGILAMDIYFPPTCVQQEALEVHDGASKGKYTIGLGQDCMAFCSEVEDVISMSLTVVTSLLEKYGIDPKQIGRLEVGSETVIDKSKSIKTFLMQIFEECGNNDIEGVDSSNACYGGTAALFNCVNWVESSSWDGRYGLVVCTDSAVYAEGPARPTGGAAAIAMLVGPDAPIAFESKLRGSHMSHAYDFYKPNLASEYPVVDGKLSQTCYLMALDSCYKLLCSKYEKLEGKQFSIADADYFVFHSPYNKLVQKSFARLVFNDVVRNASSVDEAGKQKLEPFSSLSGDESYQNRDLEKASQQVAKPLYDAKVQPSTLLPKQVGNMYTASLYAAFVSVLHNKHSELSGKRVVMFSYGSGLTATMFSFQLRDGQHPFSLSNIATVMDVAGKLKARHEFPPEKFVEILKLMEHRYGAKDFVTSKDCSLLPPGTHYLTEVDSMYRRFYSKKAGSCTCENGSLANGH

SEQ ID NO: 5252 - protein, 460 aa, Glycine max
MAKNVGILAIDIYFPPTCIQQELLEAHDGASKGKYTIGLGQDCMAFCTEVEDVISMSLTVVSSLLEKYAIDPKQIGRLEVGSETVIDKSKSIKTFIMQIFEKYGNTDIEGVDSTNACYGGTAALFNCVNWVESSSWDGRYGLVVCTDSAVYAEGPARPTGGAAAVAMLIGPDAPISFESKLRGSHMAHAYDFYKPNLASEYPVVDGKLSQTCYLMALDSCYNHLSHKYEKQEGKQFSISDAEYFVFHSPYNKLVQKSFARLVFNDFLKNASFVDEAAKEKLEPFATLSGDESYQSRDLEKASQQVAKPQYDAKVQPTTLIPKQVGNMYTASLYAAFISLIHNKHSTLDGKRVILFSYGSGLTSTMFSLLLREGQHPFSLSNIDKMMDVAGKLKSRHEFPPEKFVETMKLMEHRYGGKEFVTSKDTSLLSPGTFYLTEVDSMYRRFYAKKTSENGLVTNGH

SEQ ID NO: 5253 - protein, 469 aa, Prunus persica
MAKNVGILAADIYFPPTCIQQEALEAHDGASKGKYTIGLGQDCMAFCSEVEDVISMSLTVVTSLLEKYGIDPKQIGRLEVGSETVIDKSKSIKTFLMTVFEKHGNTDIEGVDSTNACYGGTAALFNCVNWVESSSWDGRYGLVVCTDSAVYAEGPARPTGGAAAIALLIGPDAPIAFESKIRGSHMAHVYDFYKPDLASEYPVVDGKLSQTCYLKALDSCYKELCKKYEKLEGKQFSLADAEYFVFHSPYNKLVQKSFARLVFNDSVRNASSIDEAAKEKLAPFASLPGDESYQSRDLEKVSQQVAKPLYDAKVQPTTLVPKQVGNMYTASLYAAFVSLLHNKHSSLDGKRVILFSYGSGSTATMFSLRLNAGQHPFSLENIAAVLNVGEKLKSRHEFPPEKFVEVMKIMEHRYGGKDFVTNQDISLLLPGTYYLTEVDSKYRRFYAKKEGGSTAAVTSNENGVVANGH

SEQ ID NO: 5254 - protein, 465 aa, Malus domestica
MAKNVGILAVDIYFPPTCIQQEALEAHDGASKGKYTIGLGQDCMAFCSEVEDVISMSLTVVTSLLEKYGIDPKQIGRLEVGSETVIDKSKSIKTFLMTIFEKHGNTDIEGVDSTNACYGGTAALFNCVNWVESSSWDGRYGLVVCTDSAVYAEGPARPTGGAAAIAMLIGPDAPLAFESKIRGSHMAHVYDFYKPDLASEYPVVDGKLSQTCYLKALDSCYKELCKKYEKLEGKQFSIADAEYFVFHSPYNKLVQKSFARLVFNDSVRNASSIDEAGKEKLAPFADLPGDDSYNSRDLEKASQQVAKPLYDAKVVPTTLVPKQVGNMYTASLYAAFVSLLHNKHSSLDGKRVILFSYGSGSTATMFSLRLNAGQQPFSLENIAAVMNVGEKLKARHEFPPEKFVEVMKIMEHRYGGKDFVTNQDISLLLPGTYYLTEVDSKYRRFYAKKDAAATTNANGVVANGH

SEQ ID NO: 5255 - protein, 450 aa, Phaseolus coccineus
  misc_feature (209)..(209): Xaa can be any naturally occurring amino acid
MAKNVGILAVDIYFPPTCIQQEALEAHDGASKGKYTIGLGQDCMAFCSEVEDVISMSLTVVTSLLEKYGIDPKQIGRLEVGSETVIDKSKSIKTFLMTIFEKHGNTDIEGVDSTNACYGGTAALFNCVNWVESSSWDGRYGLVVCTDSAVYAEGPARPTGGAAAIAMLIGPDAPLAFESKIRGSHMAHVYDFYKPDLASEYPVVDGKLXQTCYLKALDSCYKELCKKYEKLEGKQFSITDAEYFVFHSPYNKLVQKSFARLVFNDSVRNASSIDEAGKEKLAPFADLPGDDSYNSRDLEKASQQVAKPLYDAKVVPTTLVPKQVGNMYTASLYAAFVSLLHNKHSSLDGKRVILFSYGSGSTATMFSLRLNAGQQPFSLENIAAVMNVGEKLKARHEFPPEKFVEVMKIMEHRYGGKDFVTNQDISLLLPGTYYLTEVDSKYRRFYAKKD

SEQ ID NO: 5256 - protein, 468 aa, Prunus persica
MAKNVGILAADIYFPPTCIQQEALEAHDGASKGKYTIGLGQDCMAFCSEVEDVISMSLTVVTSLLEKYGIDPKQIGRLEVGSETVIDKSKSIKTFLMTVFEKHGNTDIEGVDSTNACYGGTAALFNCVNWVESSSWDGRYGLVVCTDSAVYAEGPARPTGGAAAIALLIGPDAPIAFESKIRGSHMAHVYDFYKPDLASEYPVVDGKLSQTCYLKALDSCYKELCKKYEKLEGKQFSLADAEYFVFHSPYNKLYKKLCPLVFNDSVRNASSIDEAATEKLAPFASLPGDESYQSRDLEKVSQQVAKPLYDAKVQPTTLVPKQVGNMYTASLYAAFVSLLHNKHNSLDGKRVILFSYGSGSTATMFSLRLNAGQHPFSLGNIAAVLNVGEKLKSRHEFPPEKFVEVMKIMEHRYGGKDFVTNQDISLLLPGTYYLTEVDSKYRRFYAKKEGGSTAAVTSNENGVVANGH

SEQ ID NO: 5257 - protein, 467 aa, Arachis hypogaea
MAKNVGILAMDIYFPPTCVQQEALEAHDGASKGKYTIGLGQDCMAFCTEVEDVISMSLTVVTSLLDKYGIDPKQIGRLEVGSETVIDKSKSIKTFLMQIFEKHGNTDIEGVDSSNACYGGTAALFNCVNWVESNSWDGRYGLVVCTDSAVYAEGPARPTGGAAAIAMLVGPDAPIAFESKLRASHMSHAYDFYKPNLASEYPVVDGKLSQTCYLMALDSCYKQLSHKYEKLNGKPFSLSDAEYFVFHSPYNKLVQKSFARLLFDDFIRDPSSVDEAAQQKLEPFANLSGDESYQSRDLEKASQQVAKPLFDAKVQPTTLIPKEVGNMYTASIYAAFASLIHNRYSVLAGKRVMLFSYGSGLTATMFSLQLRDAQHPFSLSNIAEVMDVAGKLKSRHEFPPEKFVETLKLNEHRYGAKEYVTSKDTSLLSPGTFYLTEVDSMYRRFYAKKAIENGFAPTSNGVIANGH

SEQ ID NO: 5258 - protein, 467 aa, Arachis hypogaea
MAKNVGILAMDIYFPPTCVQQEALEAHDGASKGKYTIGLGQDCMAFCTEVEDVISMSLTVVTSLLDKYGIDPKQIGRLEVGSETVIDKSKSIKTFLMQIFEKHGNTDIEGVDSSNACYGGTAALFNCVNWVESNSWDGRYGLVVCTDSAVYAEGPARPTGGAAAIAMLVGPDAPIAFESKLRASHMSHAYDFYKPNLASEYPVVDGKLSQTCYLMALDSCYKQLSHKYEKLNGKPFSLSDAEYFVFHSPYNKLVQKSFARLLFDDFIKDPSSVDEAAQQKLEPFANLSGDESYQSRDLEKASQQVAKPLFDAKVQPTTLIPKEVGNMYTASIYAAFASLIHNRYSVLAGKRVILFSYGSGLTATMFSLQLRDAQHPFSLSNIAEVMDVAGKLKSRHEFPPEKFVETLKLNEHRYGAKEYVTSKDTSLLSPGTFYLTEVDSMYRRFYAKKAIENGFAPTSKGVIANGH

SEQ ID NO: 5259 - protein, 458 aa, Artemisia annua
MGPQNVGILAMEIYFPPTCIQQDTLEDFDGVSKGKYTIGLGQDCMAFCSEVEDVISMGLTAVTSLLEKYGVDPKQIGRLEVGSETVIDKSKSIKTFLMTIFEDCGNTDIEGVDSTNACYGGTAALLNCVNWVESNSWDGRYGLVVCTDSAVYAEGPARPTGGAAAIAMLIGPDAPIAFESKFRASHMSHVYDFYKPDLASEYPVVDGKLSQTCYLMALESCYKGYCQKYEKLQGKQFSIADADYFVFHSPYNKLVQKSFARLVFSDVARSASSVDESAKEKLGQFTSLTGDESYNNRDLEKASQQVAKPHYDVKVQPGTLICKQVGNMYTASIYAAFASLIHNKNSSLDGNRVMMFSYGSGLSATMFSLRLSEGKAPFSLSNIAKVMNVDEKLKRRTELSPEKFVEIMKVMEHRYGGKDFVTSKDTTLLAPDTYYLTEVDSKYRRYYAKKTSELANGQ

SEQ ID NO: 5260 - protein, 471 aa, Medicago truncatula
MAPAAANNVGILALDIYFPPNCVQQEALEAHDGASKGKYTIGLGQDCMSFCSDVEDVISMSLTVVSTLLQKYEIDPKQIGRLEVGSETVIDKSKSIKSFLMQIFEKYGNTDIEGVDSTNACYGGTAALFNCVNWVESNSWDGRYGLVVCTDSAVYAEGPARPTGGAAAIAMLIGPDAPISFESKLRGSHMAHVYDFYKPDLASEYPVVDGKLSQTCYLMALDTCFKNFCQKYEKHEGKQFSLSDADYFVFHSPYNKLVQKSFARLVFSDFLRNPSSKDEVTNEKLGPFTTLSDDESYQSRDLEKASQQVAKPLYDEKVQPSTLIPKQVGNMYTASIYAAFASLLHNKNSSLEGKRVILFSYGSGLTATMFSLQLRETKHPFSLSNIARVMDVAEKLKSRHEFPPQKFIETLKLMEHRYGAKDYVTSKDSSLLAPGTFYLTEVDTMYRRFYTTKSSESNLTPAVNGLSVNGH

SEQ ID NO: 5261 - protein, 295 aa, Brassica rapa
MAKNVGILAMDIYFPPTCVQQEALEAHDGASKGKYTIGLGQDCLAFCTELEDVISMSFNAVTSLLEKYKIDPKQIGRLEVGSETVIDKSKSIKTFLMQLFEKCGNTDVEGVDSTNACYGGTAALLNCVNWVESNSWDGRYGLVICTDSAVYAEGPARPTGGAAAIAMLIGPDAPIVFESKLRGSHMAHVYDFYKPNLASEYPVVDGKLSQTCYLMALDSCYKHLCNKFEKLEGKEFSINDADYFVFHSPYNKLVQKSFARLLYNDFLRNASSIDEAAKESSLLIPPCPSMRVPKP

SEQ ID NO: 5262 - protein, 266 aa, Brassica napus
  misc_feature (177)..(177): Xaa can be any naturally occurring amino acid
MAKNVGILAMDIYFPPTCVQQEALEAHDGASKGKYTIGLGQDCLAFCTELEDVISMSFNAVTSLLEKYKIDPKQIGRLEVGSETVIDKSKSIKTFLMQLFEKCGNTDVEGVDSTNACYGGTAALLNCVNWVESNSWDGRYGLVICTDSAVYAEGPARPTGGAAAIAMLIGPDAPIVXESKLRGSHMAHVYDFYKPNLASEYPVVDGKLSQTCYLMALDSCYKHLCNKFEKLEGKEFSINDADYFVFHSPTTNLCRKALLVSCTTTS

SEQ ID NO: 5263 - protein, 475 aa, Glycine max
MAKNVGILAIDIYFPPACVQQEALETHDGASKGKYTIGLGQDCMSFCTEVEDVISMSLTVVTSLLEKYEIDPKLVGRLEVGSETVIDKSKSIKTFLMQIFEKYGNTDIEGVDSTNACYGGTAALFNCVNWVESNSWDGRYGLVVCTDSAVYAEGPARPTGGAAAIAMLIGPDAPISFESKLRGSHMSHVYDFYKPNLASEYPVVDGKLSQTCYLMAVDSCYKNFCHKYEKFEGKQFSLSDAEYFVFHSPYNKLVQKSFARLVFNDFLMNSSSVDEVAKEKLGPFATLSGDESYQSRDLEKASQQVAKPLYDQKVQPTTLIPKQVGNMYTASLYAAFASLIHNKNSTLAGKRVILFSYGSGLTATMFSLQLRDSQHPFSLSNIARVMDVDGKLKSRHEFPPEEFVENLKLMEHRYGGKEFVTSKDTSLLSPGTFYLTEVDSMYRRFYSKKTKESSLTPAENGVIANGVANGIANGH

SEQ ID NO: 5264 - protein, 458 aa, Artemisia annua
MAPQNVGIVAMEIYFPPTCIQQDTLENFDGVSKGKYTIGLGQDCMAFCSEVEDVISMGLTAVTSLLEKYEIDPKQIGRLEVGSETVIDKSKSIKTFLMDIFENAGNTDIEGVDSTNACYGGTAALFNCVNWVESSSWDGRYGLVVSTDSAVYADGPARPTGGAGAVAMLIGPDAPIAFESKFRASHMSHVYDFYKPDLASEYPVVDGKLSQTCYLMALDSCYKGYCQKYEKLQGKQFSMADADYFVFHSPYNKLVQKSFARLVFADVARDASSVDESAKEKLGQFTSLKGDESYQSRDLEKASQQVAKPDYDKKVQPATLVPKQLGNMYTASLYAAFASLIHNKSSSLDGNRVMMFSYGSGLSATMWSLRLTEGKAPFSLSNIAKVMNIEHKLKTRTEFAPEKFVELMHLMEHRYGGKDFVTSKDTSHLAPGTYYLTEVDSKYRRFYAKKTTEVANGH

SEQ ID NO: 5265 - protein, 461 aa, Brassica napus
MAKNVGILAMDIYFPPTCVQQEALEAHDGASKGKYTIGLGQDCLAFCTELEDVISMSFNAVTSLLEKYKIDPKQIGRLEVGSETVIDKSKSIKTFLMQLFEKCGNTDVEGVDSTNACYGGTAALLNCVNWVESNSWDGRYGLVICTDSAVYAEGPARPTGGAAAIAMLIGPDAPIVCESKLRGSHMAHVYDFYKPNLASEYPVVDGKLSQTCYLMALDSCYKHLCNKFEKLEGKEFSINDADYFVFHSPYNKLVQKSFARLLYNDFLRNASSIDEAAKEKFTPYSSLSLDESYQSRDLEKVSQQLAKTYYDAKVQPTTLVPKQVGNMYTASLYAAFASLVHNKHSDLAGKRVVMFSYGSGSTATMFSLRLCENQTPFSLSNIASVMDVGGKLKARHEYAPEKFVETMKLMEHRYGAKEFVTTKEGILDLLAPGTYYLKEVDSLYRRFYGKKGDDGSITNGH

SEQ ID NO: 5266 - protein, 468 aa, Panicum virgatum
MAGRKDVGILAMDIYFPPTCVQQEALEAHDGASKGKYTIGLGQDCMAFCSEVEDVISMSLTVVNSLLKKYNVDPKLIGRLEVGSETVIDKSKSIKTWLMQIFEKSGNTDIEGVDSSNACYGGTAALLNCVNWVESNSWDGRYGLVVCTDSAVYAEGPARPTGGAAAIAMLIGPNAPISFESKYRASHMAHVYDFYKPDLASEYPVVDGKLSQTCYLMALDSCYRQFCNKYEKIVGKQFSISDAEYFVFHSPYNKLVQKSFARLYYNDFMRNCSSIDDDAKEKLQPFSNLTGEESYQSRDLEKASQQVAKHLYDIKVQPSTLLPKQIGNMYTASLYAALASVLYNKHDSLDGQRIVMFSYGSGLTSTMFSLRLNNGQHPFSLSNIASVLGVTEKLQSRHETLPEKFIDTLKLMEHRYGAKDFETSRDTSLLPPGTFYLTHVDSMYRRFYDQKPVEGGKAKCCNGFANGH

SEQ ID NO: 5267 - protein, 464 aa, Tropaeolum majus
MAKNVGILAMDIYFPPSFVKQEELEAHDGASKGKYTIGLGQDGLAFCTEVEDVISMSLTAVSSLLEKYKIDAKEIGRLEVGSETVIDKSKSIKTFLMQIFEKSGNTDIEGVDSSNACYGGTAALLNCVNWVESNSWDGRYGLVVCTDSAVYAEGPARPTGGAAAIAMLIGPDAPIAFESKFRGSHMSHVYDFYKPDLASEYPVVDGKLSQTCYLMALDSCYKVFCSKYEKLEGKQFSISDADYFVFHSPYNKLVQKSFARLLYNDFMRNASSIDEAAKEKLGPFSTLSGDESYQSRDLEKLSQQVAKPFYDSKVQPSTLVPKQIGNMYTASIYAAFASLIHNKHSELEGKRVIMFSYGSGSTATMFSLQLRQSENPFSLSNIATVLDVAGKLKARHEVTPEKFVENLKLMEHRYGGKDFVTSQDVSLLAPGTYYLTEVDTKYRRFYAKKTSTTTCENNSIANGH

SEQ ID NO: 5268 - protein, 458 aa, Artemisia annua
  misc_feature (234)..(234): Xaa can be any naturally occurring amino acid
  misc_feature (238)..(238): Xaa can be any naturally occurring amino acid
MGPQNVGILAMEIYFPPTCIQQDTLEDFDGVSKGKYTIGLGQDCMAFCSEVEDVISMGLTAVTSLLEKYGVDPKQIGRLEVGSETVIDKSKSIKTFLMTIFEDCGNTDIEGVDSTNACYGGTAALLNCVNWVESNSWDGRYGLVVCTDSAVYAEGPARPTGGAAAIAMLIGPDAPIAFESKFRASHMSHVYDFYKPDLASEYPVVDGKLSQTCYLMALESCYKGYCQKYEKLQXKQFXIADADYFVFHSPYNKLVQKSFARLVFSDVARSASSVDESAKEKLGQFTSLTGDESYNNRDLEKASQQVAKPHYDVKVQPGTLICKQVGNMYTASIYAAFASLIHNKNSSLDGNRVMMFSYGSGLSATMFSLRLSEGKAPFSLSNIAKVMNVDEKLKRRTELSPEKFVEIMKVMEHRYGGKDFVTSKDTTLLAPDTYYLTEVDSKYRRYYAKKTSELANGQ

SEQ ID NO: 5269 - protein, 461 aa, Arabidopsis lyrata
MAKNVGILAMDIYFPPTCVQQEALEAHDGASKGKYTIGLGQDCLAFCTELEDVISMSFNAVTSLFEKYKIDPNQIGRLEVGSETVIDKSKSIKTFLMQLFEKCGNTDVEGVDSTNACYGGTAALLNCVNWVESNSWDGRYGLVICTDSAVYAEGPARPTGGAAAIAMLIGPDAPIVFESKLRGSHMAHVYDFYKPNLASEYPVVDGKLSQTCYLMALDSCYKHLCNKFKKIEGKEFSINDADYFVFHSPYNKLVQKSFARLLYNDFLRNASSIDEAAKEKFTPYSSLSLDESYQSRDLEKVSQQIAKPFYDAKVQPTTLIPKEVGNMYTASLYAAFASLIHNKHNDLAGKRVVMFSYGSGSTATMFSLRLNDNQPPFSVSNIASVMDVGGKLKARHEYAPEKFVETMKLMEHRYGAKDFVTSKEGIIDLLAPGTYYLKEVDSLYRRFYGKKGDDGSIANGH

SEQ ID NO: 5270 - protein, 458 aa, Lactuca sativa
MAPQNVGILAMEIYFPPTCIKQDTLEDFDGVSKGKYTIGLGQDCMAFCSEVEDVISMGLTAVTSLLEKYEIDPKQIGRLEVGSETVIDKSKSIKTFLMQIFEECGNTDIEGVDSTNACYGGTAALFNCVNWVESSSWDGRYGLVVSTDSAVYAEGAARPTGGAGAVAMLIGPDAPIAFESKFRASHMSHVYDFYKPDLASEYPVVDGKLSQTCYLMALDSCYKGYCQKYEKLQGKQFSMVDADYFVFHSPYNKLVQKSFARLVFDDVARNVSSVDESAKEKLGQFTSLKGDESYQSRDLEKAAQQVAKPDYDKKVKPATLIPKQLGNMYTASIYAAFASLIHNKSDSLDGNRVMMFSYGSGLSATMFSLHLSEGKGPFSLSNIAKVLNIDHKLKTRTEVVPEKFVELMHLMEHRYGGKDFVTSKDTSHLAPGTYYLTEVDSKYRRFYAKKTTELANGH

SEQ ID NO: 5271 - protein, 461 aa, Arabidopsis thaliana
MAKNVGILAMDIYFPPTCVQQEALEAHDGASKGKYTIGLGQDCLAFCTELEDVISMSFNAVTSLFEKYKIDPNQIGRLEVGSETVIDKSKSIKTFLMQLFEKCGNTDVEGVDSTNACYGGTAALLNCVNWVESNSWDGRYGLVICTDSAVYAEGPARPTGGAAAIAMLIGPDAPIVFESKLRASHMAHVYDFYKPNLASEYPVVDGKLSQTCYLMALDSCYKHLCNKFEKIEGKEFSINDADYIVFHSPYNKLVQKSFARLLYNDFLRNASSIDEAAKEKFTPYSSLTLDESYQSRDLEKVSQQIAKPFYDAKVQPTTLIPKEVGNMYTASLYAAFASLIHKKHNDLAGKRVVMFSYGSGSTATMFSLRLNDNKPPFSISNIASVMDVGGKLKARHEYAPEKFVETMKLMEHRYGAKDFVTTKEGIIDLLAPGTYYLKEVDSLYRRFYGKKGEDGSVANGH

SEQ ID NO: 5272 - protein, 461 aa, Brassica juncea
MAKNVGILAMDIYFPPTCVQQEALEAHDGASKGKYTIGLGQDCLAFCTELEDVISMSFNAVTSLLDKYKIDPKQIGRLEVGSETVIDKSKSIKTFLMQLFEKCGNTDVEGVDSTNACYGGTAALLNCVNWVESNSWDGRYGLVICTDSAVYAEGPARPTGGAAAIAMLIGPDAPIVFESKLRGSHMAHVYDFYKPNLASEYPVVDGKLSQTCYLMALDSCYKHLCNKFEKLEGKEFSINDADYFVFHSPYNKLVQKSFARLLYNDFLRNASSIDEAAKEKFTPYSSLSLDESYQSRDLEKVSQQVAKTFYDAKVQPTTLVPKEVGNMYTASLYAAFASLIHNKHSDLAGKRVVMFSYGSGSTATMFSLRLCENQSPFSLSNIASVMDIGGKLKARHEYAPEKFVETMKLMEHRYGAKEFVTSKEGILDLLAPGTYYLKEVDSLYRRFYGKKGDDGSIANGH

SEQ ID NO: 5273 - protein, 471 aa, Glycine max
MEKNVGILAIDIYFPPACVQQEALETHDGASKGKYTIGLGQDCMSFCTEVEDVISMSLTVVTSLLEKYGIDPKQIGRLEVGSETVIDKSKSIKTFLMQIFEKYGNTDIEGVDSTNACYGGTAALFNCVNWVESNSWDGRYGLVVCTDSAVYAEGPARPTGGAAAIAMLIGPDAPISFESKLRGSHMSHVYDFYKPNLASEYPVVDGKLSQTCYLMAVDSCYKNFCHKFQKFQGKQFSLFDAEYFVFHSPYNKLVQKSFARLFFNDFLMNSSSADEVAKEKLGPFATLSGDESYQSRDLEKASQLLAKPLYDQKVQPTTLIPKQVGNMYTASLYAAFASLIHNKHSTLAGKRVILFSYGSGLTATMFSLQLRDSQHPFSLSNMARVMNVDGKLKSRHEFPPEEFVENLKLMEHRYGAKEFVTSKDSSLLSPGTFYLTEVDSMYRRFYSKKTKESSLTHAENGVIANGVANGH

SEQ ID NO: 5274 - protein, 157 aa, Solanum tuberosum
MSLIPSFFGGRRSNIFDPFSLDLWDPFQGFPISTNAPSSAREISAFANAKIDWKETPEAHVFKVDVPGIKKEEVKVEVEEGRILQISGERSREQEEKNDQWHRMERSSGKFLRRFRLPENAKTGEIKAAMENGVLTVTVPKEEEKKKSEVKAIDISG

SEQ ID NO: 5275 - protein, 54 aa, Solanum tuberosum
MERSSGKFLRRFRLPENAKTGEIKAAMENGVLTVTVPKEEEKKKSEVKAIDISG

SEQ ID NO: 5276 - protein, 157 aa, Solanum phureja
MSLIPSFFGGRRSNIFDPFSLDLWDPFEGFPISTNVPSSAREISAFANAKIDWKETPEAHVFKVDVPGIKKEEVRVEVEEGRILQISGERSREQEEKNDQWHRMERSSGKFLRRFRLPENTKTGEIKAAMENGVLTVTVPKEEEKKKSEVKAIDISG

SEQ ID NO: 5277 - protein, 160 aa, Solanum tuberosum
MSLIPSFFGGRRSNIFDPFSLDLWDPFQGFPISTTLASAPSSAREISAFANAKIDWKETPEAHVFKVDVPGIKKEEVKVEVEEGRILQISGERSREQEEKNDQWHRMERSSGKFLRRFRLPENAKTGEIKAAMENGVLTVTVPKEEEKKKSEVKAIDISG

SEQ ID NO: 5278 - protein, 160 aa, Solanum lycopersicum
MSLIPSFFGGRRSNIFDPFSLDLWDPFEGFPISTTIANDPSSAREISAFANAKIDWKETPQAHVFKVDVPGINKEEVKVEVEEGRILQLSGERSREKEEKNDKWHRMERSSGKFLRRFRLPENAKTGEIKAAMENGVLTVTVPKEEEKKKSEAKAIDISG

SEQ ID NO: 5279 - protein, 157 aa, Solanum phureja
MSLIPSFFGGRKSNIFDPFSLDLWDPFEGFPISTNAPSSTREISAFANAKIDWKETPEAHIFKVDVPGIKKEEVEVEVEEGRILQISGERSREQEEKNDQWHRMERSSGKFIRRFRLPENTKTGEIKAAMENGVLTVTVPKEEEKKKSEVKAIDISG

SEQ ID NO: 5280 - protein, 160 aa, Solanum lycopersicum
MSLIPSFFGGRRSNIFDPFSLDLWDPLEGFPISTTIANNPSSAREISAFANAKIDWKETPQAHVFKVDVPGIKKEEVQVEVEEGRILQIRGERSREKKEKNDQWHRMERSSGKFLRRFRLPENAKTGEIKAAMENGVLTVTVPKEEEKKKPEVKAIEISG

SEQ ID NO: 5281 - protein, 160 aa, Solanum lycopersicum
MSLIPSFFGGRRSNIFDPFSLDLWDPLEGFPISTTIANNPSSAREISAFANVKIDWKETPQAHVFKVDVPGIKKEEVQVEVEEGRILQIRGERSREKEEKNDKWHRMERSSGKFLRRFRLPENAKTGKIKAAMENGVLTVIVPKEEEKKKSEVKAIDISG

SEQ ID NO: 5282 - protein, 157 aa, Solanum tuberosum
MSLIPSFFGGRKSNIFDPFSLDLWEGFPISTTIANAPSSAREISAFANAKIDWKETPEAHVFKVDVPGIKKEEVKVEVEEGRILQISGERSREQEEKNDQWHRMERSSGKFIRRFRLPENTKTGEIKAAMENGVLTVTVPKEEEKKKSEVKAIDISD

SEQ ID NO: 5283 - protein, 159 aa, Capsicum annuum
MSLIPSFFGGRRSNIFDPFSLDLWDPFEGFPISSTIANTPSSARETSAFANARIDWKETPQAHIFKVDVPGIKREEVKVEVEEGRILQISGERSREQEEKNDQWHRMERSSGKFLRRFRLPENTKTGEIKAAMEDGVLTVTVPKEEEKKPEVKAIDISG

SEQ ID NO: 5284 - protein, 159 aa, Capsicum annuum
MSMIPSFFGGRRSNIFDPVSLDLWDPFEGFPISSTIANTPSSARETSAFANARIDWKETPQAHIFKVDVPGIKKEEVKVEVEEGRILQISGERSREQEEKNDQWHRMERSSGKFLRRFRLPENTKMGEIKAAMENGVLTVTVPKEEEKRSEVKAIDISG

SEQ ID NO: 5285 - protein, 157 aa, Solanum tuberosum
MSLIPSFFGGRKSNIFDPFSLDLWEGFPISTTIANAPSSAREISAFANAKIDWKETPEAHVFKVDVPGIKKEEVKVEVEEGRILQISGERSREQEEKNDQWHRMERSSGKFLRRFRLPENTKTGEIKAAMENGVLTVTVPKEEEKKKFEVKAIDIFG

SEQ ID NO: 5286 - protein, 155 aa, Solanum phureja
MSLIPTFFGGRRSNIFDPFSLDIWDPLEGFPIANPPSSVNETSVFANAKIDWKETPEAHVFKVDVPGIKKEEVKVEVEEGRILQISGERSKEQEEKNDQWHRMERSSGKFVRRFRLPENVKMEEIKAAMENGVLTVTVPKEEEKKPEVKAIDISG

SEQ ID NO: 5287 - protein, 154 aa, Solanum tuberosum
MSLIPSFFGGRKSNIFDPFSLDLFEGFPISTNVPSSAREVSAFVNAKMDWKETSEAHIFKVDVPGIKKEEVKVEVEEEGILQISGERSREQEEKNDQWHRMERSSGKFLRRFRLPENTKTGEIKAAMENGVLTVTVPKEEEKKKSEVKAIDISG

SEQ ID NO: 5288 - protein, 155 aa, Solanum tuberosum
MSLIPTFFSGRRSNIFDPFSLDIWDPLEGFPIANPPSSVNETSVFANAKIDWKETPEAHVFKVDVPGIKKEEVKVEVEEGRILQISGERSKEQEEKNDQWHRMERSSGKFVRRFRLPENVKMEEIKAAMENGVLTVTVPKEEEKKPEVKAIDISG

SEQ ID NO: 5289 - protein, 150 aa, Solanum lycopersicum
  misc_feature (17)..(17): Xaa can be any naturally occurring amino acid
  misc_feature (28)..(30): Xaa can be any naturally occurring amino acid
  misc_feature (35)..(35): Xaa can be any naturally occurring amino acid
  misc_feature (38)..(38): Xaa can be any naturally occurring amino acid
  misc_feature (42)..(42): Xaa can be any naturally occurring amino acid
  misc_feature (55)..(56): Xaa can be any naturally occurring amino acid
MSLIPSFFGGRRSNIFXPFSLDLWDPFXXXTNTPXSAXEISXFANAKIDWKETPXXHVFKVDVPGIKKEEVKVEVEEGRILQISGERNREKEEKNDQWHRMERSSGKFIRRFRLPENAKTGEIKAAMENGVLTVTVPKEEEKKKPEVKAI

SEQ ID NO: 5290 - protein, 155 aa, Solanum tuberosum
MSLIPTFFGGRRSNIFDPFSLDIWDPLEGFPIANPPSSVHETSVFANAKIDWKETPEAHVFKVDVPGIKKEEVKVEVEEGRILQISGERSKEQEEKNDQWHRMERSSGKFVRRFRLPENVKMEEIKAAMENGVLTVTVPKEEGKKPEVKAIDISG

SEQ ID NO: 5291 - protein, 44 aa, Solanum tuberosum
MERSSGKFVRRFKLPENVKMEEIKAAMENGVLTVTVSKEEGKET

SEQ ID NO: 5292 - protein, 155 aa, Solanum melongena
MSLIPSFFGGRRSNIFDPFSLDLWDPFEGFQISNPPSSVRETSAFANARIDWKETPEAHVFKVDVPGINKEEVKVEVEEGRILQISGERSKEQEEKNDQWHRMERSSGKFLRRFRLPENVKMEEVKAAMENGVLTVTVPKVVEKKPEVKAIDISG

SEQ ID NO: 5293 - protein, 145 aa, Solanum phureja
MSLIPSFFGGRKSNIFDPFSLDNAPSSTREISAFANAKIDWKETPEAHIFKVDVPGIKKEEVEVEVEEGRILQISGERSREQEEKNDQWHRMERSSGKFIRRFRLPENTKTGEIKAAMENGVLTVTVPKEEEKKKSEVKAIDISG

SEQ ID NO: 5294 - protein, 164 aa, Solanum phureja
MSLIPSFFGGRKSNIFDPFSLDLWDPFPISTNAPSSAREVSAFANAKIDWKETPEAHVFKVDVPGIKKEEVKVEVEEGRILQISGERSREQEEKNDQWHRMERSSGKFIRRFRLPENTKTGEIKAAMENGVLTVTVPKEEEKKHEVKAKEEEKKHEVKAIDISG

SEQ ID NO: 5295 - protein, 149 aa, Solanum tuberosum
MSLIPSFFGGRRSNIFDPFSLDLWDPFEGFPISTNVPSSAREISAFANAKIDWKETPEAHVFKVDVPGIKKEKVKVEVEEGRILQISGERSREQEEKNDQWHRMERSSGKFIRRFRLPENTKTGEIKAGMENGVLTVTVPKEGREETWK

SEQ ID NO: 5296 - protein, 159 aa, Nicotiana tabacum
MAMIPSFFGGRRSNIFDPFSLDIFDPFEGFPFSGTVANVPSSARETSAFANARIDWKETPDSHIFKMDVPGIKKEEVKVEVEEGRVLQISGERSREQEEKNDTWHRMERSSGKFMRRFRLPENAKMEEIKAAMENGVLTVTVPKEEEKKSEVKAIDISG

SEQ ID NO: 5297 - protein, 54 aa, Solanum tuberosum
MERSSGKFMRRFRLPENTKTGEIKAAMENGVLTVTVPKEEEKKKSEVKAIDISG

SEQ ID NO: 5298 - protein, 159 aa, Nicotiana tabacum
MALIPSLFGGRRSNIFDPFSLDIFDPFEGFPFSGTVANVPSSARETSAFANARIDWKETPDSHIFKMDVPGIKKEEVKVEVEEGRVLQISGERSREQEEKNDTWHRMERSSGKFMRRFRLPENAKMEEIKAAMENGVLTVTVPKEEEKKPEVKAIDISG

SEQ ID NO: 5299 - protein, 159 aa, Nicotiana tabacum
MSLIPSFFGGRRSNIFDPFSLDLWDPFEGFPFSRTVANTPTSARETAAFASARIDWKETPESHVFKVDLPGIKKEEVKVEVEEGRVLQISGERSREEEENNDKWHRMERSSGKFLRRFRLPENTKMEEIKAAMENGVLTVTVPKMEEKKPEVKAIDISC

SEQ ID NO: 5300 - protein, 153 aa, Solanum tuberosum
MSLIPTFFGRSNIVDPLSLHIGDPFEGFPIANPPSSVRETSVFANARIDWKETPEAHVFKVDVPGIKKEEVKVEVEEGRILQISGERSKEQEEKNDQWHCMERSSGKFVRRFKLPENVKMEEIKAAMENGVLTVTVPKEEEKKPEVKAINISG

SEQ ID NO: 5301 - protein, 153 aa, Solanum tuberosum
MSLIPTFFGRSIIVDPLSLDKWDPLEGFPIANPTSSVRETSVFANARIDWKETPEAHVFKVDVPGIKKEEVKVEVEEGRILQISGERSKEQEEENDQWHCMERSSGKFVRRFRLPENVKMGEIKAAMENGVLTVTIPKEEEKKPEMKAIDISG

SEQ ID NO: 5302 - protein, 153 aa, Solanum phureja
MSLIPTFFGRSNIVDPLSLHIGDPFEGFPIANPSSSVRETSVFANARIDWKETPEAHVFKVDVPGIKKEEVKVEVEEGRILQISGERSKEQEEKNDQWHCMERSSGKFIRRFKLPENVKMEEIKAAMENGVLTVTVPKEEEKKPEVKAINISG

SEQ ID NO: 5303 - protein, 153 aa, Solanum tuberosum
MSLIPTFFGRSIIVDPLSQDIRDPFEGFPIANPSSSVRETSVFANARIDWKETPEAHVFKVDVPGIKKEEVKVEVEEGRVLQISGERSKEQEEKNDQWHCMERSSGKFVRKFRLPENVKMGEIKAAMENGVLTVTVPKEEEKKPEVKAINISG

SEQ ID NO: 5304 - protein, 156 aa, Triphysaria pusilla
MSLIPSLFGNRRSNVFDPFSLDIWDPFEGFPISGLPSSAARETTAVANARIDWKETPEAHVFKVDVPGLKKEEVKVEVEDGSILQISGERSKEQEEKNDTWYRVERSSGKFLRRFRLPEDAKLGEVKAAMENGVLTVTVPKEEVKKPEVKAIDISG

SEQ ID NO: 5305 - protein, 154 aa, Nicotiana tabacum
MSLIPSFFGGRRSNVFDPFSLDIWDPFEGFPFSGTVANVPTSAFANARIDWKETPEAHVFKVDLPGIKKEEVKVEVEEGRVLQISGERSREQVEKNDKWHRMERSSGKFLRRFRLPENTKMEEIKAAMENGVLTVTVPKMEEKKPDVKAIDISA

SEQ ID NO: 5306 - protein, 160 aa, Mimulus guttatus
MSLIPSFFGNGRRSNVFDPFSLDVWDPFEGFPFSSAVTNLPSSARETTAVANARIDWKETPEAHLFKVDVPGLKKEEVKVEVEDGSILQISGERSKEKEEKNDKWHRVERSSGKFIRRFRLPENAKLEEVKAAMENGVLTVTVPKEEVKKPEVKAIDISG

SEQ ID NO: 5307 - protein, 152 aa, Mimulus guttatus
MSLIPSFFGNGRRSNVFDPFSLDVWDPFEGFPFSSARETTAAANARIDWKETPEAHLFKVDVPGLKKEEVKVEVEDGSILQISGERSKEKEEKNDKWHRVERSSGKFIRRFRLPENAKLEEVKVAMENGVLTVTVPKEEVKKPEAKAIDISG

SEQ ID NO: 5308 - protein, 160 aa, Mimulus guttatus
MSLIPSFFGNGRRSNIFDPFSLDVWDPFEGFPFSSAVANLPSSARETTAVANARIDWKETPEAHLFKVDVPGLKKEEVKVEVEDGSILQISGERSKEQEEKNDKWHRIERSSGKFIRRFRLPENAKLEQVKAAMENGVLTVTVPKEEVKKPEVKSIDISG

SEQ ID NO: 5309 - protein, 154 aa, Triphysaria pusilla
MSLIPSIFGNRRSNVFDPFSLDIWDPFEGFPISNMPSSARETTAVANARIDWKETPEAHVFNVDVPGLKKEEVKVEVEDGSILQISGERKKEMEEKNDTWHRVERSSGKFLRRFRLPENAKLAEVKAAMENGVLTVTVPKEEVKKPAKAIDISG

SEQ ID NO: 5310 - protein, 159 aa, Theobroma cacao
MSLIPSLFGGRRTNVFDPFSLDVWDPFDGFSNSALANNVPSSARETSAFANARIDWKETPEAHVFKADLPGLKKEEVKVEVEEGRVLQISGERSKEQEEKNDTWHRVERSCGKFLRRFRLPENAKMDQIKASMENGVLTVTVPKEEEKKPEVKAIDISG

SEQ ID NO: 5311 - protein, 159 aa, Cucumis melo
MSLIPSIFGGRRSNVFDPFSLDIWDPFEGFPFSNSLANVPSSAVETSAFANTRIDWKETPQAHIFKADLPGIKKEEVKVEVEEGRVLQISGERSKEQEEKNDKWHRVERSSGKFTRRFRLPENAKVEEVKANMENGVLTVTVPKVEEKKPEIKSIDISG

SEQ ID NO: 5312 - protein, 159 aa, Nicotiana tabacum
MSLIPSFFDGRRSNIFDPFSLNIWDPFEGFPFSGTVANIPTSTRETAAFSSARIDWKETPESHVFKVDLPGIKKEEVKVEVEEGRVLQISGERSREQEEKNDKWHSMERSSGKFLRRFRLPENIKMEEIKATMENGVLTVTVPKMEEKKPEVKAIDISG

SEQ ID NO: 5313 - protein, 417 aa, Cajanus cajan
MESGVVAVNNHNYESKATSTITIKGILSLLMENIDENGRKRVISLGMGDPTLTTLFHTPNVVEDAVAHTLQSHKFHGYAPTPGLLQARIAIAEYLSRDLPYQLSSDDVFITCGCTQAIDVSVAMLARPGANILLPRPGFPIYELCAAFRGVEVRHYDLLPQKGWEVDLDAVEALADHNTVALVIINPGNPCGNVYSYHHLEKIAETAKRVGTIVIADEVYGHLAFGGKPFVPMGVFGSVVPVLTLGSLSKRWIVPGWRLGWFVTNDPSGTFRNPKVVERIKKYFDLLGGPATFIQAAVPQIIALTEEVFFKKTIDNLRLTADICCKEIKDIPCIFCPYKPEGSMAMMVKLNLSLLEDISDDIDFCFKLAKEESVIILPGTAVGLKDWLRITFAADPSALGEGMRRIKSFYQRHARKL

SEQ ID NO: 5314 - protein, 426 aa, Phaseolus coccineus
METGAVAMNNNNNIVNHHHEARATSTITIKGMLSLLMENIDENLDGGTKKVISLGMGDPTLTTLFHAPKVVEEAVADSLHSHKFHGYAPTAGLLQARIAIAEYLSRDLPYQLSSDDVFITSGCTQAIDVSVAMLARPGANILLPRPGFPIYELSAAFRGIEVRHYDLLPEKGWEVDLDAVEASADQNTAALVIINPGNPCGNVYSYHHLEKIAETAKRVGTIVISDEVYGHLAFGAKPFVPMGVFGSVVPVLTLGSLSKRWIVPGWRLGWFVTNDPSGTFREPKVVERIKKYFDLLGGPATFIQAAVPQIIANTEEIFFNKTIDNLRHTADICCTEIKDIPCIFCPYRPEGSMAMMVKLNLSLLEDISDDIDFCFKLAKEESVIILPGTAVGLKDWLRITFAADPCALGEGMRRMKSFCQRHVRKL

SEQ ID NO: 5315 - protein, 417 aa, Medicago truncatula
MESGVGTMNHECKATSTITIKGILSLLMESVGENNDDNSKRVISLGMGDPTLSTCFPNAKVAEEAVADALCSGNFHGYAPTAGLLQARNAIAKYLSDDLPYELSSDDVFITCGCTQAIDVSVALLSRPGANILLPRPGFPIYELCAAFRQVEVRHYDLLPEKGWEVDLDAIETLVDQNTVALVIINPGNPCGNVYTYHHLEKIAETAKRLGTIVIADEVYGHLAFGDNPFVPMGVFGSTVPVITLGSLSKRWIVPGWRLGWFVTNDPSGTFRKPKVVERIKKYFDLLGGPATFIQAAVPRIITQTEEVFFRKTIDKLRHTADICCQEMEDIPCISFPCKPQGSMAMMVELNLSLLEDISDDIDFCFKLAKEESVIILPGTAVGLKDWIRITFAADPSALRDGMQRIKSFSQRHARKQ

SEQ ID NO: 5316 - protein, 414 aa, Lotus japonicus
MESGVVGVNHECKTTSTITIKGILSLLMETIDDGSSKRVISLGMGDPTLATCFHTTKVSEDAVADTLQSHKFHGYAPTAGLLQTRNAIAEYLSRDLPYQLSSDDVFITSGCTQAIDVSMALLARPGANILLPRPGFPIYELSASFRQVEVRHYDLLPEKGWEVDLDAIEALADQNTVALVIINPGNPCGNVYSYHQLEKIAETAKRLGTVVIADEVYGHLAFGANPFVPMGIFGSTVPVITLGSLSKRWIVPGWRLGWFVTNDPCGTFRKPKVVEHIKKYFDLLGGPATFIQAAVPRIIKQTEEVFFKKTVEILKYTSEICCKKIEDIPCIFCPCKPEGSMAMMVKLNLSLLEDISDDIDFSFKLAKEESVIILPGTAVGLKDWLRITFAADPSALAEGMDRIQCFCQRHAKKQ

SEQ ID NO: 5317 - protein, 315 aa, Vigna unguiculata
METGAVAMNNNSSNVIHHQNETRATSTITIKGILSLIMENIDVNLDGGNKRVISLGMGDPTLTTLFHTPKVVEEAVADSLHSHKFHGYAPTAGLPQARIAIAEYLSRDLPYKLSSDDVFITCGCTQAIDVSVAMLARPGANILLPRPGFPIYELSTAFRGVEVRHYDLLPEKGWEVDLDAVEALADQNTVGLVIINPGNPCGNVYSYHHLEKIAETAKRVGTIVISDEVYGHLAFGAKPFVPMGVFGSVVPVLTLGSLSKRWIVPGWRLGWFVTNDPSGTFREPKVVERIKKYFDLLGGPPTFIQRHVLTDERLD

SEQ ID NO: 5318 - protein, 63 aa, Glycine max
MAELSLGILIDIVDEEWMRDTLPDDDLPLPPTLVVRTDDTEDSNQETQQVNVDAWHDLAFGQE

SEQ ID NO: 5319 - protein, 63 aa, Unknown
  Sequence found in Organisms: Phaseolus coccineus, Cajanus cajan
MAELSLGILIDIVDEEWMRDTLPDDDLPLPPTLVVRTDDTEDSNQETQQVNADAWHDLALGQE

SEQ ID NO: 5320 - protein, 63 aa, Vigna unguiculata
MAELSLGILIDIVDEEWMRDTLPDDDLPLPPTLVVRTDDTEDSNQETQQVNVDAWHDLALGQE

SEQ ID NO: 5321 - protein, 63 aa, Glycyrrhiza uralensis
MAELSLGILVDIVDEEWMRDTLPEDDLPLPPTLVVRTDDTEDSNQETQQVNVDAWHDLALGQE

SEQ ID NO: 5322 - protein, 63 aa, Medicago truncatula
MAELSLGILIDIVDEDWMRDTLPQDDLPLPPTLVVRTDDTEDSNQEAQQVNKDAWHDLALGQE

SEQ ID NO: 5323 - protein, 63 aa, Acacia harpophylla
MAELSLGILIDIVDEEWMRDTLPDDDLPLPPTLIVRTDDTEDSNQETQQINADSWHDLAMGPE

SEQ ID NO: 5324 - protein, 63 aa, Arachis hypogaea
MAEVSLGILIDIVDEEWMRDTLPDDDLPLSPTLVVRTDDTEDPNQETQEVNADAWHDLALGQE

SEQ ID NO: 5325 - protein, 63 aa, Manihot esculenta
MAELSLGVLIDVVDEEWMRDTLPDDDLPLPPVLVVRTDDGEDSNQETQQVNGDTWHDLALGNQ

SEQ ID NO: 5326 - protein, 63 aa, Citrus sinensis
MAELSQGILIDIVDEEWMRDTLPDDDLPLPPVLVVRPDDTEDSNQEPQQVNEDTWHDLAMGTQ

SEQ ID NO: 5327 - protein, 63 aa, Populus trichocarpa
MAELNMGILIDIVDEEWMRDTLPDDDLALPPVMVVRTDDTEDSNQETQHVDTDAWHDLALGNQ

SEQ ID NO: 5328 - protein, 65 aa, Lotus japonicus
MAEVSLGILIDVVDEEWMRDTIPDDDLPLPPTLVVRTDDTEETNQETQHVNEDKWHDLALGREVH

SEQ ID NO: 5329 - protein, 85 aa, Coffea canephora
APPLLSPSFTESHSRKKGRKGMAECPSLGILIDIVDEDWMRDTLPDDDLPLPPVLVSRTDDTEDSNQEVQQVDGDTWHDLALGNS

SEQ ID NO: 5330 - protein, 64 aa, Coffea canephora
MAECPSLGILIDIVDEDWMRDTLPDDDLPLPPVLVSRTDDTEDSNQEVQQVDGDTWHDLALGNS

SEQ ID NO: 5331 - protein, 62 aa, Orobanche aegyptiaca
MAELTLGILIDILDEEWMRDTLPDDDLPLPPVLVSRTDETEDSNQETQPVEADTWHDLALGN

SEQ ID NO: 5332 - protein, 63 aa, Vitis vinifera
MAELSLGVLIDIVDEEWMRDTLPVDDLPLPPVLVARTEDTEDSNQENQQVDGDTWHDLALGAQ

SEQ ID NO: 5333 - protein, 63 aa, Prunus persica
MAELNPGILIDIVDEEWMRSTLPDDELPLPPVLVVRTDDTEDSNQETQRVAADGWHDLALGSQ

SEQ ID NO: 5334 - protein, 72 aa, Unknown
  Sequence found in Organisms: Castanea mollissima, Quercus alba
MAEISLGILIDIVDEDWMRDTLPNDDLPLPPVLVVRNDDTEESNQETQQVGGDTWHDLALGTQYSSHASGGA

SEQ ID NO: 5335 - protein, 162 aa, Arabidopsis lyrata
MEKQAKLTRTQSSLLRSSSNLRSSFQSLSSIVEGEQDLEAGEKEEKQRRKPPKPFGSSSPKSGLTRINPGLAFTMVSLSFLSLSSFFFFVVFSQTDEILTSENLLLALIFVAVALFFASKNIALLNQTVIAIKQISGFKAETQNQNRYNGTSETILNRRRRS

SEQ ID NO: 5336 - protein, 424 aa, Brassica napus
MEGQAKLTRTQSSLLRSPSTTVRSSFQSLSVIASEVSHQRQDLEAGEKEEKQRRKPPKPFGSSPRTGLTRINPGLAFTMVSLSFLSLSSFIFFVVFSQTDELLTSENLLLALIFVAVALFFASKNIALLNQTILALKETTKLFGFHSKNRSEPVQWYIGDTETKPEKKIKPFVKEGVHFYSNGDFYEGEFHKGKCNGSGVYYYFVRGRYEGDWVDGRYDGHGIESWARGSRYKGQYRQGLRHGYGVYRFYTGDCYAGEWLNGQSHGFGVQSCADGSSYVGESRFGVKHGLGSYHFRNGDKYAGEYFGDKIHGFGVYRFANGHCYEGAWHEGRKQGYGAYSFRTGDAKSGEWDSGNLITFLHPTSEPVRRAVQAARETAKKAVTRRRVDEQVSRAVAAANKAATAARVAAVKAVQNQMDGNFCQS

SEQ ID NO: 5337 - protein, 412 aa, Brassica napus
  misc_feature (194)..(194): Xaa can be any naturally occurring amino acid
  misc_feature (217)..(217): Xaa can be any naturally occurring amino acid
  misc_feature (267)..(267): Xaa can be any naturally occurring amino acid
MEGQAKLTRTQSSLLRSPSTTVRSSFQSLSVIASEVSHQRQDLEAGEKEEKQRRKPPKPFGSSPRTGLTRINPGLAFTMVSLSFLSLSSFIFFVVFSQTDELLTSENLLLALIFVAVALFFASKNIALLNQTILALKETTKLFGFHSKNRSEPVQWYIGDTETKPEKKIKPFVKEGVHFYSNGDFYEGEFHKGXCNGSGVYYYFVRGRYEGDWVDGXYDGHGIESWARGSRYKGQYRQGLRHGYGVYRFYTGDCYAGEWLNGQSHGXGVQSCADGSSYVGESRFGVKHGLGSYHFRNGDKYAGEYFGDKIHGFGVYRFANGHCYEGAWHEGRKQGYGAYSFRTGDAKSGEWDSGNLITFLHPTSEPVRRAVQAARETAKKAVTRRRVDEQVSRAVAAANKAATAARVAAVKA

SEQ ID NO: 5338 - protein, 315 aa, Arachis hypogaea
MSTSRSVGSPSSRSEQTMATPASDSTFLRLNHLDIHGDDAGSQGAVASKKKKRGQRAVGGDKSGRGLRQFSMKVCEKVESKGRTTYNEVADELVAEFADPSNSVLAPDQQQYDEKNIRRRVYDALNVLMAMDIISKDKKEIQWKGLPRTSQSDIEELKTERLGIRNRIEKKAAYLQELEEQYVGLQNLIKRNEQVCSSGNAPSGGVSLPFILVQTRPHATVEVEISEDMQLVHFDFNSTPFELHDDNYVLKAMKFSERPQNDNNVTPNVTDGGEGSSMSGLFHVQAPTTVSNPPVRPPSSPPLPGILKARVKPEH

SEQ ID NO: 5339 - protein, 235 aa, Arabidopsis lyrata
MVYFQNSISVVDQSPVMAQSADFHHHSKQSRSSSNRKSSSSSSSCSSHFQVCCDGSRSAAIDVLILIAVITSSGFLIFPYIKFITVKSVEIFSELSCLVKEEILRNPDPIVYGLIALSISCTALSAWMIVILLCSRHRCGKPNCKGLRKANAEFDIQLETEDCVKSSNSGKSVSKKGLFELPRDHHRELEAELKKMAPPNGRAVLVFRAKCGCSVGRLEVPGPKKQQLQQRKVKK

SEQ ID NO: 5340 - protein, 67 aa, Arabidopsis lyrata
MCLEVVYHEEKTELGRQQAPGMCPYCGGKVSAVDIETKWLFCFLPLCFKVKRKYSCSSCDRRLVLYY

SEQ ID NO: 5341 - protein, 67 aa, Brassica napus
MCLEFVYHEEKTELGRQQAPGVCPYCGGKVSAVDIETKWLFCFLPLCFKVKRKYSCSSCDRRLVLYY

SEQ ID NO: 5342 - protein, 67 aa, Brassica napus
MCLELVYHEEKTELGRQQAPGVCPYCGGKVSAVDIETKWLFCFLPLCFKVKRKYSCSSCDRRLVLYY

SEQ ID NO: 5343 - protein, 67 aa, Brassica oleracea
MCLELVYHEEKTELGRQQVPGVCPYCGGKVSAVDIETKWLFCFLPLCFKVKRKYSCSSCDRRLVLYY

SEQ ID NO: 5344 - protein, 67 aa, Brassica napus
MCLELVYHEEKTELGRQQAPGVCPYCGGKVSAVDVETKWLFCFLPLCFKVKRKYSCSSCDRRLVLYY

SEQ ID NO: 5345 - protein, 67 aa, Brassica napus
MCLEFVYHEEKTELGRQQAPGVCPYCGGKVAAVDIETKWLFCFLPLCFKVKRKYSCSSCDRRLVLYY

SEQ ID NO: 5346 - protein, 126 aa, Raphanus sativus
GQQSPCEQKKTSSHFIIFFPFLVIFSHFLFFTLPEAETSPEDIYRHKKGSLSKKNKEAKMCLEFVYHEEKTELGRQQAPGVCPYCGGKVAAVDTETKWLFCFLPLCFKVKRKYSCSSCNRRLVLYY

SEQ ID NO: 5347 - protein, 67 aa, Unknown
  Sequence found in Organisms: Brassica rapa, Raphanus sativus
MCLEFVYHEEKTELGRQQAPGVCPYCGGKVAAVDIETKWLFCFLPLCFKVKRKYTCSSCDRRLVLYY

SEQ ID NO: 5348 - protein, 67 aa, Cleome gynandra
MCLVFVFNEETTELGRQQAPGMCPYCDGKVSAIDVETKWMFCFLPLCFKIKRKYFCSSCDRRLVLYY

SEQ ID NO: 5349 - protein, 51 aa, Thellungiella halophila
MDPLPEPVTYVCGDCGQENTLKSGDVIQCRECGYRILYKKRTRRVVQYEAR

SEQ ID NO: 5350 - protein, 51 aa, Thellungiella halophila
MDPQPEPVTYVCGDCGQENTLKSGDVIQCRECGYRILYKKRTRRVVQYEAR

SEQ ID NO: 5351 - protein, 51 aa, Unknown
  Sequence found in Organisms: Brassica napus, Brassica juncea, Brassica oleracea, Brassica rapa, Raphanus sativus
MDQQPEPVTYVCGDCGQENTLKSGDVIQCRECGYRILYKKRTRRVVQYEAR

SEQ ID NO: 5352 - protein, 76 aa, Brassica oleracea
RSCSRSSHTTLIPEKPKLCLIRVDIMDQQPEPVTYVCGDCGQENTLKSGDVIQCRECGYRILYKKRTRRVVQYEAR

SEQ ID NO: 5353 - protein, 102 aa, Brassica napus
  misc_feature (4)..(10): Xaa can be any naturally occurring amino acid
DVGXXXXXXXLSLSLSLSLSLVSSLVFETIARINPNSAETLALSGKIRVDRMDQQPEPVTYVCGDCGQENTLKSGDVIQCRECGYRILYKKRTRRVVQYEAR

SEQ ID NO: 5354 - protein, 52 aa, Arabidopsis lyrata
MEPAQPEPVTYVCGDCGQENTLKPGDVIQCRECGYRILYKKRTRRVVQYEAR

SEQ ID NO: 5355 - protein, 51 aa, Helianthus annuus
MDPAPEPVTYICGDCGQENTLKVGDVIQCRECGYRILYKKRTRRIVQYEAR

SEQ ID NO: 5356 - protein, 51 aa, Raphanus sativus
MDQQPEPVTYVCEDCGQENTLKSGDVIQCRECGYRILYKKRTRRVVQYEAR

SEQ ID NO: 5357 - protein, 51 aa, Unknown
  Sequence found in Organisms: Artemisia annua, Gerbera hybrid cultivar, Lactuca sativa, Carthamus tinctorius
MDPQPEPVTYICGDCGQENTLKVGDVIQCRECGYRILYKKRTRRIVQYEAR

SEQ ID NO: 5358 - protein, 51 aa, Cleome gynandra
MDPQPEPVTYICGDCGQENTLKPGDVIQCRECGYRILYKKRTRRIVQYEAR

SEQ ID NO: 5359 - protein, 51 aa, Cleome spinosa
MDPQPEPVTYICGDCGQENTLKTGDVIQCRECGYRILYKKRTRRIVQYEAR

SEQ ID NO: 5360 - protein, 51 aa, Unknown
  Sequence found in Organisms: Gossypium hirsutum, Theobroma cacao, Heritiera littoralis
MDPQPEPVTYICGDCGQENTLKHGDVIQCRECGYRILYKKRTRRIVQYEAR

SEQ ID NO: 5361 - protein, 51 aa, Tropaeolum majus
MDPQPEPVTYICGDCGQENTLKSADVIQCRECGYRILYKKRTRRIVQYEAR

SEQ ID NO: 5362 - protein, 51 aa, Lactuca sativa
MDPPPEPVTYICGDCGQENTLKVGDVIQCRECGYRILYKKRTRRIVQYEAR

SEQ ID NO: 5363 - protein, 60 aa, Cleome gynandra
MDPLPEPVTYICGDCGQENTLKPGDVIQCRECGYRILYKKRTRRIVQYEATMRTTTQGYS

SEQ ID NO: 5364 - protein, 51 aa, Cleome spinosa
MDPQPEPVTYICGDCGHENTLKHGDVIQCRECGYRILYKKRTRRIVQYEAR

SEQ ID NO: 5365 - protein, 51 aa, Unknown
  Sequence found in Organisms: Beta vulgaris, Coffea canephora, Cyamopsis tetragonoloba, Panax ginseng, Vitis vinifera, Actinidia deliciosa, Orobanche aegyptiaca
MDPQPEPVSYICGDCGQENTLKPGDVIQCRECGYRILYKKRTRRIVQYEAR

SEQ ID NO: 5366 - protein, 51 aa, Taraxacum officinale
MDPQPEPVTYICGDCGQENTLKVGDSIQCRECGYRILYKKRTRRIVQYEAR

SEQ ID NO: 5367 - protein, 51 aa, Brassica napus
MDQQSEPVTYVCGDCGKENTLKSGDVIQCRERGYRILYKKRTRRVVQYEAR

SEQ ID NO: 5368 - protein, 82 aa, Catharanthus roseus
MQNEEGQNMDLYIPRKCSATNRLITSKDHASIQMNLGHLDERGVYTGAFSTFALCGFVRAQGDADSALDRLWQKKKVEVRQQ

SEQ ID NO: 5369 - protein, 51 aa, Centaurea maculosa
MDQQPEPVTYICGDCGQENTLKVGDVIQCRECGYRILYKKRTRRIVQYEAR

SEQ ID NO: 5370 - protein, 51 aa, Gossypium hirsutum
MDPQPEPVTYICGDCGQENTLKHGDVIQCRECGYRILYKKRTRRIIQYEAR

SEQ ID NO: 5371 - protein, 51 aa, Cynara scolymus
MDPQPEPVTYICGDCGQENTLKVGDVIQCRECGYRILYKKRTRIIVQYEAR

SEQ ID NO: 5372 - protein, 97 aa, Mesembryanthemum crystallinum
VLDKQRRYHYLSSSKIVYINTLPLHPSNPQATIFLSSHRFLISTLTMDPQPEPVSYICGDCGQENTLKPGDVIQCRECGYRILYKKRTRRIVQYEAR

SEQ ID NO: 5373 - protein, 51 aa, Mimulus guttatus
MDPQPEPVSYICGDCGQENTLKQGDVIQCRECGYRILYKKRTRRIVQYEAR

SEQ ID NO: 5374 - protein, 54 aa, Petunia hybrida
GTGWMLHQRPVSYICGDCGQENTLKSGDVIQCRECGYRILYKKRTRRIVQYEAR

SEQ ID NO: 5375 - protein, 52 aa, Brachypodium distachyon
MDPQQPEPVSYLCGDCGAENTLKSGDVIQCRECGYRILYKKRTRRIVQYEAR

SEQ ID NO: 5376 - protein, 52 aa, Avena sativa
MDPQQPEPVTYLCGDCGAENTLKAGDVIQCRECGYRILYKKRTRRIVQYEAR

SEQ ID NO: 5377 - protein, 52 aa, Musa acuminata
MDPLQPEPVSYICGDCGAENTLKPGDVIQCRECGYRILYKKRTRRVVQYEAR

SEQ ID NO: 5378 - protein, 75 aa, Vigna unguiculata
ECASGPKRNLKPRTFFFYSLPESPMDPQPEPVSYICGDCGMENTLKPGDVIQCRECGYRILYKKRTRRIVQYEAR

SEQ ID NO: 5379 - protein, 72 aa, Ipomoea nil
TAGAVWLCQNYYCSERCALESMDAQPEPVSYICGDCGQENTLKQGDVIQCRECGYRILYKKRTRRIVQYEAR

SEQ ID NO: 5380 - protein, 88 aa, Cucumis melo
FCLVFPSPIIIVKPYATSISFSALASPSQRKIFEVSLMDPQPEPVSYICGDCGMENTLKQGDVIQCRECGYRILYKKRTRRIVQYEAR

SEQ ID NO: 5381 - protein, 63 aa, Elaeis guineensis
EKENPSLRFWSQMDPQPEPVSYICGDCGAENTLKPGDVIQCRECGYRILYKKRTRRIVQYEAR

SEQ ID NO: 5382 - protein, 51 aa, Unknown
  Sequence found in Organisms: Glycine max, Phaseolus coccineus, Bruguiera gymnorhiza, Manihot esculenta, Citrus sinensis, Glycyrrhiza uralensis, Lotus japonicus, Cajanus cajan, Populus trichocarpa, Juglans hindsii x Juglans regia
MDPQPEPVSYICGDCGMENTLKPGDVIQCRECGYRILYKKRTRRIVQYEAR

SEQ ID NO: 5383 - protein, 51 aa, Unknown
  Sequence found in Organisms: Ricinus communis, Cucumis sativus, Eschscholzia californica, Cucumis melo
MDPQPEPVSYICGDCGMENTLKQGDVIQCRECGYRILYKKRTRRIVQYEAR

SEQ ID NO: 5384 - protein, 51 aa, Linum usitatissimum
MDPLPEPVSYICGDCGTENTLKPGDVIQCRECGYRILYKKRTRRIVQYEAR

SEQ ID NO: 5385 - protein, 51 aa, Ipomoea batatas
MDAQPEPVSYICGDCGQENTLKQGDVIQCRECGYRILYKKRTRRIVQYEAR

SEQ ID NO: 5386 - protein, 51 aa, Tropaeolum majus
MDPQHEPVTYICGDCGQENTLKPADVIQCRECGYRILYKKRTRRIVQYEAR

SEQ ID NO: 5387 - protein, 51 aa, Salvia sclarea
MDAQPEPVNYICGDCGQENTLKQGDVIQCRECGYRILYKKRTRRIVQYEAR

SEQ ID NO: 5388 - protein, 51 aa, Ocimum basilicum
MDAQPEPVSYICGDCGQENTLKPGDVIQCRECGYRILYKKRTRRIVQYEAR

SEQ ID NO: 5389 - protein, 51 aa, Fagus grandifolia
MDPLPEPVNYICGDCGMENTLKTGDVIQCRECGYRILYKKRTRRIVQYEAR

SEQ ID NO: 5390 - protein, 51 aa, Cichorium intybus
MDPPPEPVTYICGGCGQENTLKVGDVIQCRECGYRILYKKRTRRIVQYETR

SEQ ID NO: 5391 - protein, 51 aa, Liriodendron tulipifera
MDPQPEPVSYICGDCGTENTLKPGDVIQCRECGYRILYKKRTRRIVQYEAR

SEQ ID NO: 5392 - protein, 51 aa, Medicago truncatula
MDPLPEPVSYLCGDCGVENTLKSGDVIQCRDCGYRILYKKRTRRIVQYEAR

SEQ ID NO: 5393 - protein, 53 aa, Cryptomeria japonica
MDGPAMPEPVGYLCGDCGAENTLKPGDVIQCRECGYRILYKKRTRRIVQYEAR

SEQ ID NO: 5394 - protein, 78 aa, Triticum aestivum
TRIAFFPPSSPSRTLACYKPYSFPSPMDPQQPEPVSYLCGDCGAENTLKTGDVIQCRECGYRILYKKRTRRIVQYEAR

SEQ ID NO: 5395 - protein, 73 aa, Triticum aestivum
NLQTPTSLRTTCRRKTLERSAMDPQQPEPVSYLCGDCGAENTLKPGDVIQCRECGYRILYKKRTRRIVQYEAR

SEQ ID NO: 5396 - protein, 75 aa, Triticum aestivum
RTLTFLNPNSSLSSPSRHSTALPMDPQQPEPVSYLCGDCGAENTLKTGDVIQCRECGYRILYKKRTRRIVQYEAR

SEQ ID NO: 5397 - protein, 52 aa, Unknown
  Sequence found in Organisms: Hordeum vulgare, Triticum aestivum
MDPQQPEPVSYLCGDCGAENTLKTGDVIQCRECGYRILYKKRTRRIVQYEAR

SEQ ID NO: 5398 - protein, 52 aa, Unknown
  Sequence found in Organisms: Solanum lycopersicum, Solanum melongena, Capsicum annuum, Solanum tuberosum, Solanum phureja, Nicotiana tabacum
MDSQPVEPVSYICGDCGQENTLKPGDVIQCRECGYRILYKKRTRRIVQYEAR

SEQ ID NO: 5399 - protein, 52 aa, Unknown
  Sequence found in Organisms: Zea mays, Pennisetum glaucum, Oryza sativa, Sorghum bicolor, Saccharum officinarum, Panicum virgatum
MDPQQPEPVSYLCGDCGAENTLKPGDVIQCRECGYRILYKKRTRRIVQYEAR

SEQ ID NO: 5400 - protein, 52 aa, Nuphar advena
MDPQQPEPVSYICGDCGAENTLKPGDVIQCRECGYRILYKKRTRRIVQYEAR

SEQ ID NO: 5401 - protein, 51 aa, Ipomoea nil
MDAQPEPVSYICGDCGQDNTLKQGDVIQCRECGYRILYKKRTRRIVQYEAR

SEQ ID NO: 5402 - protein, 51 aa, Unknown
  Sequence found in Organisms: Castanea mollissima, Quercus alba
MDPPPEQVNYICGDCGMENTLKPGDVIQCRECGYRILYKKRTRRIVQYEAR

SEQ ID NO: 5403 - protein, 51 aa, Triphysaria pusilla
MDAQPEPVSYICGDCGQDNTLKPGDVIQCRECGYRILYKKRTRRIVQYEAR

SEQ ID NO: 5404 - protein, 51 aa, Ocimum basilicum
  misc_feature (20)..(20): Xaa can be any naturally occurring amino acid
MDAQPEPVSYICGDCGQENXLKPGDVIQCRECGYRILYKKRTRRIVQYEAR

SEQ ID NO: 5405 - protein, 51 aa, Bruguiera gymnorhiza
  misc_feature (15)..(15): Xaa can be any naturally occurring amino acid
MDPQAEPVSYVCGDXGTENTLKPGDVIQCRECGYRILYKKRTRRIVQYEAR

SEQ ID NO: 5406 - protein, 51 aa, Arachis hypogaea
MDPQAEPVSYICGDCGMENTLKPGDVIQCRECGYRILYKKRTRRIVQYEAR

SEQ ID NO: 5407 - protein, 51 aa, Pisum sativum
MDPMPEPVSYLCGDCGIENTLKTGDVIQCRDCGYRILYKKRTRRIVQYEAR

SEQ ID NO: 5408 - protein, 62 aa, Ipomoea nil
AFNSAAKTEATMDAQPEPVSYICGDCGQDNTLKQGDVIQCRECGYRILYKKRTRRIVQYEAR

SEQ ID NO: 5409 - protein, 65 aa, Euphorbia esula
PIVSEGKKKPPREFMDPQPEPVSYICGDCGMENTLKTGDLIQCRECGYRILYKKRTRRIVQYEAR

SEQ ID NO: 5410 - protein, 73 aa, Cryptomeria japonica
VISSFGTVGRYLAGFELLSTMDGPAVPEPVGYICGDCGAENALKPGDVIQCRECGYRILYKKRTRRIVQYEAR

SEQ ID NO: 5411 - protein, 85 aa, Picea glauca
MHVNTINIMGGVNSSQKPFEHLDIIPPPPRYSHTELPAKIRSCLCNRQLLNLHLQYDTSFNQALSYHGWTCSARTCELHLWRLWS

SEQ ID NO: 5412 - protein, 88 aa, Zamia vazquezii
MDGPAPPEPVSYICGDCGAENTLKPGDVINVENVAIGFSIKNALEELFNMKLAKAVLLTKAMEGGNQNIPDLGVCTYMCAWKNTSFFK

SEQ ID NO: 5413 - protein, 53 aa, Pinus taeda
MDGPAMPEPVGYICGDCGAENSLKPGDVIQCRECGYRILYKKRTRRIVQYEAR

SEQ ID NO: 5414 - protein, 52 aa, Cynodon dactylon
MDPQPPEPVSYLCGDCGTENTLKPGDVIQCRDCGYRILYKKRTRRIVQYEAR

SEQ ID NO: 5415 - protein, 52 aa, Amborella trichopoda
MDPPQTEPVSYICGDCGVENTLKPGDVIQCRECGYRILYKKRTRRIVQYEAR

SEQ ID NO: 5416 - protein, 172 aa, Arachis hypogaea
NIPLPNQVDYYIKVQGQLTQQIGGSALQCHLSKSIFVVVIGSNDLFGYFNSKDLQNKSTPQQYVDSMTSSLKLQLQRLYEQGARKFEIAGIGAIGCCPSNRLKNKTECFSEANYWALKYNEDLKTLLKNWQLEKKDIRYSYFDTYAAIEDLIQSPISYGFREIKLLVVELVS

SEQ ID NO: 5417 - protein, 117 aa, Arachis hypogaea
YGTTPLSLSLSQQPLSLSLSQQQQQPPPSPNCSRQPEGASPTAVTDRRSARSSWPSILFSSPSSPLDLQIEARGRLLYIVFVFVFVVVDLQIEARSVGFLFGSSLVVSVLLPCCTET

SEQ ID NO: 5418 - protein, 52 aa, Eucalyptus gunnii
MCTVTPARSNSSSVLGAVFICQLIRLCKPGDGSTHDKIDAIRSASNYHIGLR

SEQ ID NO: 5419 - protein, 61 aa, Arachis hypogaea
RICFPLSKKTLASVTLLFKLCHRHRPTAAVVPTASLDHASQSLTRPEARTLKCESLPLLQP

SEQ ID NO: 5420 - protein, 53 aa, Unknown
  Sequence found in Organisms: Pinus taeda, Picea glauca
MDGHAAPEPVSYICGDCGAENSLKPGDVIQCRECGYRILYKKRTRRIVQYEAR

SEQ ID NO: 5421 - protein, 58 aa, Helianthus annuus
LICSNQSMDPAPEPVTYICGDCGQENTLKVGDVIQCRECGYRILYKKRTRRIVQYEAR

SEQ ID NO: 5422 - protein, 52 aa, Pennisetum glaucum
MDPQQPEPVSYLCGDCGSENTLKPGDVIQCRDCGYRILYKKRIRRIVQYEAR

SEQ ID NO: 5423 - protein, 52 aa, Papaver somniferum
MDSQPAEPVSYICGDCGMENTLKPGDVIQCRECGYRILYKKRTKRIVQYEAR

SEQ ID NO: 5424 - protein, 51 aa, Prunus persica
MDPQPEPVYYICGDCGMEIPLKPNDVIQCRECGYRILYKKRTRRIVQYEAR

SEQ ID NO: 5425 - protein, 51 aa, Papaver somniferum
MDPPQDPVSYICGDCGMENTLKPGDVIQCRECGYRILYKKRTKRIVQYEAR

SEQ ID NO: 5426 - protein, 48 aa, Raphanus sativus
MDQQPEPVTYVCGDCGQENTLKSGDVIQCRECGYRILYKKRTRRGERC

SEQ ID NO: 5427 - protein, 62 aa, Eragrostis curvula
PPFFEDARPDRIRSTPEPVTYLCGDCGAENTLKPGDVIQCRDCGYRILYKKRTRRIVQYEAR

SEQ ID NO: 5428 - protein, 117 aa, Mimulus guttatus
MDPQPEPVSYICGDCGQENTLKQGDVIQCRECGYRILYKKRTRRNEPRCYVSCILESWYFAIICMVRLLYILTLRTETISLGLDRHLVKRLKELRKLFNMKLVEVNIKVPPCSGCSV

SEQ ID NO: 5429 - protein, 60 aa, Solanum phureja
SLLTVDHQWDSQHVEPVSYICGDCGQENTLKPGDVIQCRECGYRILYKKRTRRIVQYEAR

SEQ ID NO: 5430 - protein, 55 aa, Marchantia polymorpha
MDHGGPAPPEPVTYLCGDCGADNTLKPGDVIQCRECGYRILYKKRTRRIVQFEAR

SEQ ID NO: 5431 - protein, 52 aa, Physcomitrella patens
MSAPPPEPVTYLCGDCGADNTLKPGDVIQCRECGYRILYKKRTRRIVQFEAR

SEQ ID NO: 5432 - protein, 52 aa, Malus domestica
MDPPPPEAVYYICGDCGMEVQLKSNDVIQCRECGYRILYKKRTRRIVQYEAR

SEQ ID NO: 5433 - protein, 52 aa, Zingiber officinale
  misc_feature (4)..(4): Xaa can be any naturally occurring amino acid
  misc_feature (21)..(21): Xaa can be any naturally occurring amino acid
  misc_feature (30)..(31): Xaa can be any naturally occurring amino acid
MDPXQPEPVSYICGDCGAENXLKPGDVIQXXECGYRILYKKRTRRIVQYEAR

SEQ ID NO: 5434 - protein, 56 aa, Adiantum capillus-veneris
MDGGMAQPPPEPVSYLCGDCGADNALKPGDVIQCRECGYRILYKKRTRRIVQYEAR

SEQ ID NO: 5435 - protein, 56 aa, Lactuca sativa
MDPPPEPVTYICGDCGQENTLKVGDVIQCRECGYRILYKKRTRRSKSSHLCYLSFM

SEQ ID NO: 5436 - protein, 45 aa, Solanum tuberosum
MQQPILNRLTESVFSTLNMYVPVIQYKASIIQLCVCLSLRPYLQL

SEQ ID NO: 5437 - protein, 71 aa, Solanum melongena
MSRGNQRDRDRERAQARGNHKPKTPKNDGLTPEQRRERDAKALQEKAKKKAAQAAGGCNIDKPEGHIIKKK

SEQ ID NO: 5438 - protein, 62 aa, Solanum phureja
MSRGNQRDRDRERAQARGNHKSKTPKHDGLTPEQRRERDAKALQEKAKKKAAQAGDGWNIDK

SEQ ID NO: 5439 - protein, 1200 aa, Arabidopsis lyrata
MVGGGTKRRRRRLQLSKLYTLTCAQACFKQDHSQIGGPGFSRVVYCNEPDSPEADSRNYCDNYVRTTKYTLATFLPKSLFEQFRRVANFYFLVTGILAFTPLAPYTASSAIVPLLFVIGATMVKEGVEDWRRQKQDNEVNNRKVKVHRGDGSFDSKEWKTLSIGDIVKVEKNEFFPADLVLLSSSYEDAICYVETMNLDGETNLKVKQGLEVTSSLRDEFNFKGFEAFVKCEDPNANLYSFVGTMELRGAKYPLSLQQLLLRDSKLRNTDFIFGAVIFTGHDTKVIQNSTDPPSKRSMIEKKMDKIIYLMFFMVVTMAFIGSVIFGVTTRDDFKDGVMKRWYLRPDSSRIFFDPKRAPVAAVYHFLTAIMLYSYFIPISLYVSIEIVKVLQSIFINQDIHMYYEEADKPARARTSNLNEELGQVDTILSDKTGTLTCNSMEFIKCSVAGTAYGRGVTEVEMAMGTRKGGPLVFQSDENDMEYSKEAITEESTVKGFNFRDERIMNGNWVTETHADVIQKFFRLLAVCHTVIPEVDEDTEKISYEAESPDEAAFVIAARELGFEFFNRTQTTISVRELDLVSGKRVERLYKVLNVLEFNSTRKRMSVVVQDEDGKLLLLCKGADNVMFERLSKNGREFEAETRDHVNEYADAGLRTLILAYRELDEKEYKVFNERISAAKSSVSADRESLIEEVTEKIEKDLILLGATAVEDKLQNGVPDCIDKLAQAGIKIWVLTGDKMETAINIGFACSLLRQDMKQIIINLETPEIHSLEKTGEKDVIAKVSKENVLSQIINGKAQLKYSGGNSDAFALIIDGKSLAYALDDDIKHIFLELAVGCASVICCRSSPKQKALVTRLVKSGNGKTTLAIGDGANDVGMLQEADIGVGISGVEGMQAVMSSDIAIAQFRYLERLLLVHGHWCYRRISTMICYFFYKNITFGFTLFLYETYTTFSSTPAYNDWFLSLYNVFFSSLPVIALGVFDQDVSARYCLKFPLLYQEGVQNVLFSWRRILGWMFNGFYSAVIIFFLCKSSLQSQAFNHDGKTPGREILGGTMYTCIVWVVNLQMALAISYFTLIQHIVIWSSIVVWYFFIMVYGELPSRISTGAYKVFVEALAPSLSYWLITLFVVVATLMPYFIYSALQMSFFPMYHGMIQWLRYEGQCNDPEYCDMVRQRSIRPTTVGFTARLEAKKRSVRISEPAS

SEQ ID NO: 5440 - protein, 1185 aa, Arabidopsis lyrata
MATVSGRRRKRKIQFSKLFTLTGAKACFKPDHSKIGRSGFSRVVFCNQPDSPEAESKNYCDNYVRTTKYTLTTFLPKSLFEQFRRVANFYFLVVGILSFTPLAPYTAVSAIVPLTFVILATMFKEGVEDWRRKQQDIEVNSRKVRVHRGNGNFDLREWKTLRVGDILKVEKNEFFPADLVLLSSSYEDAVCYVETMNLDGETNLKLKQGLEVTLSLREELNFRDFDAFIKCEDPNANLYSFVGTMDLKGAKYPLSPQQLLLRGSKLRNTDYIYGVVIFTGPDTKVVQNSTEPPSKRSMIERKMDKIIYLMFLMVFSLAFFGSVLFGISTRDDFQNGVMKRWYLKPDDSSIFFDPKRAPMAAIYHFLTALMLNSYFIPISLYVSIEIVKVLQSIFINQDIHMYYEEADKPAHARTSNLNEELGQVGTILSDKTGTLTCNSMEFIKCSIAGTAYGRGVTEVEMAMDRRKGSALVNQSNGNSTDDAVAAEPAVKGFNFRDERIMDGNWVTETRAGVIQKFFQLLAVCHTVIPEVDEDTGKISYEAESPDEAAFVIAARELGFEFFTRTQTTISVRELDLVTGERVERLYKVLNVLEFSSSRKRMSVIVQDQDGKLLLLCKGADSVMFERLSESGRKYEKETRDHVNEYADAGLRTLILAYRELDENEYEVFTERISEAKNSVSADREALIDEVTEKIEKNLVLLGATAVEDKLQNGVPDCIDKLAQAGIKIWVLTGDKMETAINIGFACSLLRRDMKQIIINLETPEIQQLEKSGEKDAIAAALKENVLHQITSGKAQLKASGGNAKAFALIIDGKSLAYALDEDMKGIFLELAIGCASVICCRSSPKQKTLVTRLVKTGSGQTTLAIGDGANDVGMLQEADIGVGISGVEGMQAVMSSDIAIAQFRYLERLLLVHGHWCYRRIAKMICYFFYKNITFGFTLFLYEAYTSFSATPAYNDWYLSLYSVLFTSLPVICLGIFDQDVSAPFCLKFPVLYQEGVQNLLFSWRRILSWMFHGFCSAIIIFFLCKTSLESQAFNHEGKTAGRDILGGTMYTCVVWVVSLQMVLTISYFTLIQHVVIWGSIVIWYLFLMVYGSLPIRVSTDAYMVFLEALAPAPSYWITTLFVVLSTMMPYFIFCAIQMRFFPMSHGTIQLLRYEDQCSNSGNFEMGRQRSVRPTLVMRSHQPES

SEQ ID NO: 5441 - protein, 1184 aa, Arabidopsis thaliana
MATVSGRRRKRKIQLSKLFTLTGAKACFKPDHSKIGRSGFSRVVFCNQPDSPEAESRNYCDNYVRTTKYTLATFLPKSLFEQFRRVANFYFLVVGILSFTPLAPYTAVSAIVPLTFVILATMFKEGVEDWRRKQQDIEVNNRKVRVHRGNGNFDLREWKTLRVGDILKVEKNEFFPADLVLLSSSYEDAVCYVETMNLDGETNLKLKQGLEVTLSLREELNFRDFEAFIKCEDPNANLYSFVGTMDLKGEKYPLSPQQLLLRGSKLRNTDYIYGVVIFTGPDTKVVQNSTDPPSKRSMIERKMDKIIYLMFLMVFSLAFFGSVLFGIWTRDDFQNGVMERWYLKPDDSSIFFDPKRAPMAAIYHFLTALMLNSYFIPISLYVSIEIVKVLQSIFINQDIHMYYEEADKPAHARTSNLNEELGQVGTILSDKTGTLTCNSMEFIKCSIAGTAYGRGVTEVEMAMDKRKGSALVNQSNGNSTEDAVAAEPAVKGFNFRDERIMDGNWVTETHADVIQKFFQLLAVCHTVIPEVDEDTGKISYEAESPDEAAFVIAARELGFEFFTRTQTTISVRELDLVTGERVERLYSVLNVLEFSSSKKRMSVIVQDQDGKLLLLCKGADSVMFERLSESGRKYEKETRDHVNEYADAGLRTLILAYRELDENEYEVFTERISEAKNSVSADREALIDEVTEKIEKNLVLLGATAVEDKLQNGVPDCINKLAQAGIKIWVLTGDKMETAINIGFACSLLRRDMKQIIINLETPEIQQLEKSGEKDAIAALKENVLHQITSGKAQLKASGGNAKAFALIIDGKSLAYALEEDMKGIFLELAIGCASVICCRSSPKQKALVTRLVKTGSGQTTLAIGDGANDVGMLQEADIGVGISGVEGMQAVMSSDIAIAQFRYLERLLLVHGHWCYRRISKMICYFFYKNITFGFTLFLYEAYTSFSATPAYNDWYLSLYSVFFTSLPVICLGIFDQDVSAPFCLKFPVLYQEGVQNLLFSWRRILSWMFHGFCSAIIIFFLCKTSLESQAFNHEGKTAGRDILGGTMYTCVVWVVSLQMVLTISYFTLIQHVVVWGSVVIWYLFLMVYGSLPIRMSTDAYMVFLEALAPAPSYWITTLFVVLSTMMPYFIFSAIQMRFFPMSHGTVQLLRYEDQCSNSGNFEMGRQGSVRPTLVMRSHQPES

SEQ ID NO: 5442 - protein, 1260 aa, Arabidopsis lyrata
MGVGYPLPLPPDKNRREVNKPPDIASTSSSSASAVNARLSDAPILLFVYFHKAFRAQLAELHFLAGDTVRSGSDLAVELRYKFDFLKLVYKYHSAAEDEVIFSALDTRVKNIVFNYSLEHDATDDLFTSVFHWLNVLEEEKGNRAHVLREVVLCIGTIQSSICQHMLKEERQVFPLMIENFSFEEQASLVWQFICSVPVMVLEEIFPWMTSLLSPKEKSEVENCVKEVVPKEVTLQLVINSWLVDDIPSSLTALTKIMKGVQYVEVSVNMNNSSSSSGMFQRFWQWSKMSFSSPNTGHTLVHGIQLWHNAIKKDLVDIQKGLCQLTFPSLSLDLNVLVVRLNFLADVLIFYSNALKKFFYPVFEEMVDQQHSSFSKQFTIDDHVENFKKSLDLETRTGSDNFVITLQEKLESLILTVTKQFSIEETEVFPIISKNCNIEMHRQLLYRSLHVLPLGLLKCVIMWFSAQLPEDECHSIIHFLSSEDSFLNKPFAHLLLQWFRFGYSGKTPVESFWNELSFMFKPRCSVEEEHTEEASGSFVHQSQPQLCKGSDPYLLKNKSSTYFQSMDPPLGYMNETPYSSAMNQQILIPGKLRPLQHLPDIFGNKNIGEHLNMDLKPIDLIFFFHKAMKKDLDYLVCGSARLATDCSFLGEFHQRFHLIKFLYQIHSDAEDEIAFPALEAKGKLQNISQSYSIDHELEVEHLDKVSFLLNEMAELNMLVLDHKNVKYEKLCMSLQDICKSIHKLLSEHLHREETELWCLFRDCFTIAEQEKIIASMLGRISGEILQDMIPWLMESLIPDEQHAVMSLWRQATRKTMFGEWLTEWYNSHIVEEETEEANKDPSENSDPLDIVWSYLVEGAADEDKVSICSKPLEETELKGLMNKPLGNASPNNKGEFGNKEENHREISESKKVCTGADERKYKEQTDSNAQAFQMLQNTSQSGHDSRYECLLSMSQEDVEATIRRISRDSALDPQKKSYIIQNLLMSRWIATQRIYNLEPSILSSNREAVPGQNPSYRDPHKLIFGCKHYKRSCKLLAPCCNKLYTCIRCHDEEVDHLLDRKQITKMMCMKCMIIQPVGASCSNTSCNSSMGKYYCKICKLFDDDREIYHCPYCNLCRLGKGLSIDYFHCMKCNACMSRTLVEHVCREKCLEDNCPICHEYIFTSNSPVKALPCGHVMHSTCFQEYTCSHYTCPICSKSLGDMQVYFRMLDALLAEQKMPDEYLNQTQIILCNDCGRKGNAPYHWLYHKCSSCASYNTRLF

SEQ ID NO: 5443 - protein, 135 aa, Unknown
  Sequence found in Organisms: Solanum tuberosum, Solanum phureja
MAKSTKILSSILLLFFIFTLFSSSNALGGKLGGRTQIKDVKTNQEIQDLGKYCVEEHNRNLRKQNGALSSLLSFSQVVEAEKQVVSGVKYYLKISAIVKSSSSPKLFDAVVVVKSWEKKKEELLTFFPSPSPATK

SEQ ID NO: 5444 - protein, 131 aa, Solanum melongena
MAKSRKFLSSILLVFFIFTLFSSSNALGGKVGGRTQIKDVKTNQEIQDLGKYCVEEHNRHLQKQNGGLLSFSQVVEAEKQVVSGIKYYLKISAISKSSGSPQMFDAVVVVKAWEKKKELLTFSPSPSPATK

SEQ ID NO: 5445 - protein, 103 aa, Arabidopsis lyrata
MEGLEKFYSKMVKDAKSAVSSSSSSLSDFADNLMQDKRGAGSNLTSYDAGSGVLVNRPPSGVSVWTCSKLCAVFFVAGVFVGYTLKRRVRRWASKLLRRIKDD

SEQ ID NO: 5446 - protein, 103 aa, Raphanus sativus
MEGVEKFFSKMVTDAKSAASSSSSSLSDFADNLIQEKRAGGGGNSTSYESSGILVTRPPSGVSGWTCSKLCAVFFVAGVFVGYTLKRRVRSWASKLLRRIRDD

SEQ ID NO: 5447 - protein, 319 aa, Arabidopsis lyrata
MESEIASEFPPFCRIYKDGRVERLMGTETIPASLDPTHDVVSKDVIYSPDHNLSVRLFLPHKSTKLTAGEKLPLLIYIHGGAWIIESPFSPIYHNYLTEVVKSANCLAVSVQYRRAPEDPVPASYEDAWSAIQWIFSHSNGSGPVDWINKHADFDKVFLAGDSAGGNISHHMAMKAGEEKNLDLKIKGIGVVHPAFWGTDPVDEYDVQDRETRIGIADVWEKIVSPNSVNGTDDPLFNVNGSGSDFSGLGCEKVLVAVAGKDVFVRQGLAYAAKLEKSEWKGTVEVVEEEGEGHVFHLEKPSSDKALRFLKKFVEFIIG

SEQ ID NO: 5448 - protein, 113 aa, Arabidopsis lyrata
MRTLEESKISIVFLLLLLFSIFISFSHQANEVLPSEGEKMMVPLMEEKFMVMNETRRKLGSFQICSVCTCCGGAKGLCLPSPCCYAINCNIPNRPFGYCSFTPKTCNCFGCHI

SEQ ID NO: 5449 - protein, 115 aa, Thellungiella halophila
MRALEESRISIVLLLLCFSIFITFSLQANELIPSSKEEGEMRMVPLMEEKFMVMNETRRKLGSFQICSVCTCCGGAKGLCLPSPCCYAINCNIPNRPFGYCSFTPKTCNCFGCHI

SEQ ID NO: 5450 - protein, 115 aa, Brassica napus
MSALEESKVSIVLWLLCFSIFFTSSLQANELTTPSKEEGEMRMVPLMEEKYMVMNETRRKLGSFQICSVCTCCGGAKGLCLPLPCCFAINCNIPNRPFGYCSFTPKSCNCFGCHI

SEQ ID NO: 5451 - protein, 115 aa, Brassica rapa
MSALEESKGSIVLWLLFFSIFFTSSLQANELTTPSKEEGEMRMVPLLEEKYMVMNETRRKLGSFQICSVCTCCGGAKGLCLPLPCCFAINCNIPNRPFGYCSFTPKSCNCFGCHI

SEQ ID NO: 5452 - protein, 115 aa, Raphanus sativus
MSALEESKVYIFLWLLCFSIFFTSSLQANELTTPSKEEGEMRMVPLMEEKFMVMNETRRKLGSFQICSVCTCCGGAKGLCLPSPCCFAINCNIPNRPFGYCSFTPKSCNCFGCHI

SEQ ID NO: 5453 - protein, 436 aa, Arabidopsis lyrata
MANDAAACAERATNDMLIGPDWAINIELCDIINMDPSQAKEAVKVLKKRLGSKNSKVQILALYALETLSKNCGENVYQLFIDRDILIDMVKLVKKKPDLNVREKILSLLDTWQEAFGGRGGRYPQYYNAYNDLRSAGIEFPPRTESSLSFFTPPQTQPDDDAAIQASLQGDVASSLSLEEIQSAEGSVDVLMDMLGALDPGNPESLKEEVIVDLVEQCRTYQRRVMTLVNTTTDEELLCQGLALNDNLQRVLQRHDDIAKVSSVPSNGRNTRAPPPVQIANINHDVEDDESDDEFARLAHRPPPPPTMRPVHGSDSGMVDFLSGDVYKPQGSSSQGVKKPPHASSSPVFDDASPQSKSSEVIRNLPPPPSRHNQRQQFFEHHHSSSGSDSSYEGLTRNLALTTSEPKKEEKPEDLLFKDLVEFAKTRSSKPNNRSL

SEQ ID NO: 5454 - protein, 69 aa, Brassica juncea
MAEDEVVDPKKYLEESCKPKCVKPLLEYQACVKRIQGDESGHKHCTGQYFDYWHCIDKCVAPKLFAKLK

SEQ ID NO: 5455 - protein, 69 aa, Cleome gynandra
MADEEVVDPKKYLEESCKPKCVKPLLEYQACVKRIQGDETGHKHCTGQYFDYWHCVDKCVAPKLFAKLK

SEQ ID NO: 5456 - protein, 69 aa, Cleome spinosa
MADEEVVDQKKYLEESCKPKCVKPLLEYQACVKRIQGDETGHKHCTGQYFDYWHCIDKCVAPKLFPKLK

SEQ ID NO: 5457 - protein, 69 aa, Prunus persica
MADEEPVDQKKYLEESCKPKCVKPLLEYQACVKRIQGDESGHKHCTGQYFDYWSCVDKCVAPKLFPKLK

SEQ ID NO: 5458 - protein, 69 aa, Brassica rapa
MADEEVVDPKKYLEESCKPKCVKPLLEYQACVKRIQGDESGHKHCTGQYFDYWHCIDKCVAPKLFAKLK

SEQ ID NO: 5459 - protein, 69 aa, Castanea mollissima
MAEEEPVDQKKYFEELCKPKCVKPLLEYQACVKRIQGDESGHKHCTGQYFDYWSCVDKCAAPKIFSKLK

SEQ ID NO: 5460 - protein, 152 aa, Citrus sinensis
MKMEVEIHPNNKTVVEYQEEYIRNARGVQLFTCRWLLFSTPKAVVFLCHGYGMECSGFMRECGTRLASAGYAVFGIDYEGHGRSRGARCYIKKFENIVNDCDDFFKSVCAQEEYTDKARFLYGESNGRSSYPSASQKGPFFLEWCCPCCTNV

SEQ ID NO: 5461 - protein, 67 aa, Arabidopsis lyrata
RAEEEDVDQKRYFEESCKPKCVKPLLEYQACVKRIQDDESGHKHCTGQYFDYWHCVDKCVDLSCSRD

SEQ ID NO: 5462 - protein, 69 aa, Artemisia annua
  misc_feature (5)..(5): Xaa can be any naturally occurring amino acid
MADEXPVDPKKYLEESCKPKCVKPLLEYQACVKRIQGDESGHKHCTGQYFDYWSCVDKCVAPKLFDKLK

SEQ ID NO: 5463 - protein, 69 aa, Unknown
  Sequence found in Organisms: Brassica napus, Brassica juncea, Brassica rapa
MAEDEVVDPKKYLEESCKPKCVKPLLEYQACVKRIQGDDSGHKHCTGQYFDYWHCIDKCVAPKLFAKLK

SEQ ID NO: 5464 - protein, 69 aa, Unknown
  Sequence found in Organisms: Brassica napus, Brassica oleracea
MAEDEVVDPKKYLEESCKPKCVKPLLEYQACVKRIQSDDSGHKHCTGQYFDYWHCIDKCVAPKLFAKLK

SEQ ID NO: 5465 - protein, 69 aa, Quercus alba
MAEEEPVDQKKYYEELCKPKCVKPLLEYQACVKRIQGDESGHKHCTGQYFDYWSCVDKCAAPKIFSKLK

SEQ ID NO: 5466 - protein, 69 aa, Brassica juncea
  misc_feature (65)..(65): Xaa can be any naturally occurring amino acid
MAEDEVVDPKKYLEESCKPKCVKPLLEYQACVKRIQGDDSGHKHCTGQYFDYWHCIDKCVAPKLXAKLK

SEQ ID NO: 5467 - protein, 69 aa, Brassica juncea
MGDVEVVDPKKCLEESCKPKCVKPLLEYQACVKRIQDDESGHKHCTGQYFDYWQCVDKCVGPKLFAELK

SEQ ID NO: 5468 - protein, 69 aa, Raphanus sativus
  misc_feature (54)..(54): Xaa can be any naturally occurring amino acid
MADVEVVDPKKCLEESCKPKCVKPLLEYQACVKRIQDDESGHKHCTGQYFDYWXCVDKCVGPKLFAELK

SEQ ID NO: 5469 - protein, 70 aa, Euphorbia esula
MADEEPVDQKRYYEEACKPKCVKPLLEYEACVKRIRGDESGHKHCTGQYFDYWSCVDKCVSNHFIVSTSS

SEQ ID NO: 5470 - protein, 69 aa, Unknown
  Sequence found in Organisms: Brassica napus, Brassica oleracea
MADEEVVDPKKYLEESCKPKCVKPLLEYQACVKRIQGDDSGHKHCTGQYFDYWHCIDKCVAPKLFAKLK

SEQ ID NO: 5471 - protein, 69 aa, Acacia harpophylla
MADEEPVDPKGYLEESCKPKCVKPLLEYQACVKRIQGDESGHKHCTGQYFDYWACIDKCVASKLFSKLK

SEQ ID NO: 5472 - protein, 69 aa, Unknown
  Sequence found in Organisms: Arabidopsis lyrata, Raphanus sativus
MADDEVVDPKKYLEESCKPKCVKPLLEYQACVKRIQGDDSGHKHCTGQYFDYWHCIDKCVAPKLFAKLK

SEQ ID NO: 5473 - protein, 64 aa, Brassica juncea
MADEEVVDPKKYLEESCKPKCVKPLLEYQACVKRIQGDDSGHKHCTGQYFDYWQCIDKCVAPKL

SEQ ID NO: 5474 - protein, 69 aa, Brassica juncea
MGDVEVVDPKKCLEESCKPKCVKPLLEYQACVKRIQNDESGHKHCTGQYFDYWQCVDKCVGPKLFAELK

SEQ ID NO: 5475 - protein, 69 aa, Brassica juncea
MAEDEVVDPKKYLEESCKPKCVKPLLEYQACVKRIQGDDSGHKHCTGQYFDYWQCIDKCVAPKLFTKLK

SEQ ID NO: 5476 - protein, 69 aa, Cucumis melo
MADEEPVDQKRYLEEACKPKCVKPLLEYQACVKRIQGDDSGHKHCTGQYFDYWSCIDKCVAPKLFTKLK

SEQ ID NO: 5477 - protein, 69 aa, Tropaeolum majus
MADEEPVDQKQLLEEACKPKCVKQLLEYQACVKRIQDDESGHKHCTGQYFDYWSCVDKCVARKLFAKLK

SEQ ID NO: 5478 - protein, 69 aa, Persea americana
MADEEPVDPKKYLEESCKPKCVKPLLEYQACVKRIQGDETGHKHCTGQYFDYWACVDKCVAPKLFPQLK

SEQ ID NO: 5479 - protein, 69 aa, Theobroma cacao
MADEDPVDQKKYLEEACKPKCVKPLLAYQECVKRIQGDESGHKHCTGQYFDYWSCVDKCVAPKLFSELK

SEQ ID NO: 5480 - protein, 69 aa, Nuphar advena
  misc_feature (69)..(69): Xaa can be any naturally occurring amino acid
MADEELVDQKKYIEESCKPKCVKPLLEYQACVKRIQEDETGHKHCTGQYFDYWSCVDKCAAPTLFAKLX

SEQ ID NO: 5481 - protein, 69 aa, Populus trichocarpa
MADEEPVDPKKYLEESCKPKCVKPLLEYQACVKRIQGDETGHKHCTGQYFDYWSCVDKCVALKLFSKLK

SEQ ID NO: 5482 - protein, 69 aa, Raphanus sativus
MAEDEVVDPKKYLEESCKPKCVKPLLEYQACVKRIQGDDSGHKHCTGQYFDYWQCIDKCVAPKLFAKLK

SEQ ID NO: 5483 - protein, 69 aa, Raphanus sativus
MADVEVVDPKKCLEESCKPKCVKPLLEYRACVKRIQDDESGHKHCTGQYFDYWQCVDKCVGPKLFAELK

SEQ ID NO: 5484 - protein, 65 aa, Camellia sinensis
MADEELVDQKKYYEESCKPKCVKSLLEYQACVKRIQDDDSGHKHCTGQYFDYCLVLTNVLHPSCL

SEQ ID NO: 5485 - protein, 59 aa, Brassica juncea
MAEDEVVDPKKYLEESCKPKCVKPLLEYQACVKRIQGDDSGHKHCTGQYFDYWHCIDKC

SEQ ID NO: 5486 - protein, 647 aa, Arabidopsis lyrata
MTGPSVEKTGSTRFIVFFIVLNLSIFSLSIEARSSQQHASFPPRGWNSYDSFCWTISEAEFLQSAEIVSKRLLPHGYQYVVVDYLWYRKKVEGAYVDSLGFDVIDEWGRLHPDPARWPSSRGGKGFTEVAEKVHRMGLKFGIHVMGGISTQAYNANTLVMDSVKGGAYEESGRQWRAKDIGIKEKACVWMSHGFMSVNTKLGAGKAFLRSLYRQYAEWGIDFIKHDCVFGTDFNIEEITYVSEVLKELDRPVLYSISPGTSVTPTMAKEVSQLVNMYRITGDDWDTWKDVAAHFDISRDLSASSMIGARGLQGKSWPDLDMLPLGWLTDQGSNVGPHRACNLNLEEQKSQMTLWSIAKSPLMFGGDVRKLDDTTYNLITNPTLLEINSYSSNNKEFPYITVTRVSRNKHKSHPHHPTGNNISTKHAFGLTSCKEPKTNTWSIVDKNRGQICWNQYSSQKLEKPFCLYNRKALPASDEEIKHNQLYQGKLHLQTNEKAESCLGASSKQKLTSKDYSRGTLSPCKLDANQMWELHSNGTLENSYSGLCAVLNPVKAAEATSNGVRSWIATGRRGEVYVAFFNLNQEKTTISAKIIDIAKALPNKKNLEGASCTSHELWSGKDFGPTKDSVSIQVEPHGPALFVLHCSHA

SEQ ID NO: 5487 - protein, 640 aa, Brassica napus
MIRHALERTGTTLRSLLFFFLLLNLSIYSISINARSNEDASFPPRGWNSYDSFCWTISETEFLQSAETISKRLLPHGYQYVVVDYLWYRKKVQGAYVDSLGFDVIDEWGRMHPDPARWPSSKGGKGFTQVAEKVHKMGLKFGIHVMGGISTQAYNANTLVMDSVKGGAYEESGRQWRAKDIGMKEKACVWMPHGFMSVNTKLGAGKAFLRSLYRQYAEWGIDFIKHDCVFGDDFNLDEITIVSEVLKELDRPVLYSISPGTSVTPTMAKEVSQLVNMYRITGDDWDTWRDVVAHFDISRDLSASNMIGAQGLQGKSWPDLDMLPLGWLTDQGSNLGPHRLCNLTMEEQKTQMTLWSIAKSPLMFGGDVRKLDDATYNLITNPTLLEINSYSSNNMEFPYITAARNNPHHSIGNNVKTKHAFGLTSCKEPKASTWSVVDKNNGKICWNQYSTEKPEKPFCLYNRKALLSSEEIQHNQLYQGKLHLQTNDKAESCLGASSRKKLTSKDYSRGALSPCKLDANQMWELHSNGTLENSYSGLCAVLNPVKAAEASSNGVRSWIASGRRGEVYVAFFNLNQVKTTVSAKISDIAKALQNKTHLEGASCKSHEIWSGKDFGPTKDSVTIQVESHGPALFVLHCSHA

SEQ ID NO: 5488 - protein, 494 aa, Brassica napus
  misc_feature (280)..(280): Xaa can be any naturally occurring amino acid
  misc_feature (289)..(289): Xaa can be any naturally occurring amino acid
  misc_feature (305)..(305): Xaa can be any naturally occurring amino acid
  misc_feature (310)..(310): Xaa can be any naturally occurring amino acid
MIRHALERTGTTLRSLLFFFLLLNLSIYSISINARSNEDASFPPRGWNSYDSFCWTISETEFLQSAETISKRLLPHGYQYVVVDYLWYRKKVQGAYVDSLGFDVIDEWGRMHPDPARWPSSKGGKGFTQVAEKVHKMGLKFGIHVMGGISTQAYNANTLVMDSVKGGAYEESGRQWRAKDIGMKEKACVWMPHGFMSVNTKLGAGKAFLRSLYRQYAEWGIDFIKHDCVFGDDFNLDEITIVSEVLKELDRPVLYSISPGTSVTPTMAKEVSQLVNMYRXTGDDWDTWXDVVAHFDISRDLSASXMIGAXGLQGKSWPDLDMLPLGWLTDQGSNLGPHRLCNLTMEEQKTQMTLWSIAKSPLMFGGDVRKLDDATYNLITNPTLLEINSYSSNNMEFPYITAARNNPHHSIGNNVKTKHAFGLTSCKEPKASTWSVVDKNNGKICWNQYSTEKPEKPFCLYNRKALLSSMRRYNTISSIKVSSIYKQMIKQSLV

SEQ ID NO: 5489 - protein, 449 aa, Arabidopsis lyrata
MQVVKYSDRFRKPLPDKEGNDFRTKHKPFPFSCNVSDTGFKILGNRVKWANWKFHVGFTARAGVTISTASVLDPRTKRFRRVMYRGHVSETFVPYMDPTYEWYYRTFMDIGEFGFGRSAVTLQPLIDCPQNAAFLDGHVAGPDGTAQSMTNVMCVFEKNGYGASFRHTEINVPGHVITSGEADISLVVRMVATLGNYDYIVDWEFKKNGAIRVGVDLTGVLEVKATSYTSNDQITDNVYGTLVAKNTIAVNHDHYLTYYLDLDVDGNGNSLVKAKLRTVRVTDVNKTSSRRKSYSTVVKETAKTEADGRVRLGSEPVELLIVNPKKKTKIGNTVGYRLIPEHLPVTSLLTDDDYPEIRAGYTKYPVWITAYNRSERWAGGFYSDRSRGDDGLAVWSSRNREIENKDIVMWYNVGFHHIPYQEDFPVMPTLHGGFTLRPSNFFDNDPLIG

SEQ ID NO: 5490 - protein, 311 aa, Thellungiella halophila
MEIDGGDRVSGQKPIIMVTNDDGIDAPGLRSLVRVLVSTNLYDVRVCAPDSEKSAVSHSIIWSRPLTAQRVEIDGAVAYAVSGTPADCTGLGLSEALFPSLPDLVLSGINVGSNCGYNIVYSGTVAGAREAFIYDVPSVSISYDWKRGDINVNDFVLAAQACLPIINGILSAIKNKTHPTNCFLNIDLPTDIANHKGYKLTTQGKSLGKMGWRQVEEKAQGAKMLSTMTMETDSGVVSENGTSADHSQDTRLFKRELRTVLVEEGTDLHFLREGYITVTPLGALSQVDVDCQDYYKEWLPKITNQPYSSSL

SEQ ID NO: 5491 - protein, 321 aa, Brassica napus
  misc_feature (3)..(9): Xaa can be any naturally occurring amino acid
LLXXXXXXXKITEAMAINGEDRISGERPIIMVTNDDGIDAPGLRSLVRVLVSTNLYDVRVCAPDSEKSAVSHSIIWSRPLTAHRVEIEGAEAYAVSGTPADCTGLGLSEALFPSLPDLVLSGINVGSNCGYNIVYSGTVAGAREAFIYDVPSASISYDWKRGDINVNDFVLSAQACLPIINGMLSAIKNKTHPTNCFLNIDLPTDIANHKGYKLTTQGKSLCKMGWRQVEEEAQGAKMLSTMSMETDSGVVSDNNDTSAHHSNDSRLFKREVRTVVVEEGTDLHFLREGYITVTPIGALSQVDVDCQNYYKEWLPKISSSL

SEQ ID NO: 5492 - protein, 328 aa, Raphanus sativus
  misc_feature (228)..(228): Xaa can be any naturally occurring amino acid
  misc_feature (267)..(268): Xaa can be any naturally occurring amino acid
  misc_feature (271)..(271): Xaa can be any naturally occurring amino acid
  misc_feature (319)..(319): Xaa can be any naturally occurring amino acid
GSSFSYLIRLLLIRYTERAMAINGEDRISGDRPIIMINNDDGIDAPGLRSLVSVLVSTNLYQVRVCAPDSEKSAVSHSIIWSRPLTAKRVEIEGAEAYAVSGTPADCTGLGISEALFPSLPDLVLSGINVGSNCGYNIVYSGTVAGAREAFIYDVPSASISYDWKRGDINANDFVLAAQACLPIINGMLTAIKNKTHPTNCFLNIDLPTDIANHKGYKLTRQGKSLGXMGWRQVEEEAQGAKMLSTMSMETDSGVVSDNNNDTSAHXXKDXSRLFKRELRTVIVEEGTDLHFLREGYITVTPIGALSQVDVDCQNYYKXWLPKISSSL

SEQ ID NO: 5493 - protein, 307 aa, Brassica napus
MAINGEDRISGERPIIMVTNDDGIDAPGLRSLVRVLVSTNLYDVRVCAPDSEKSAVSHSIIWSRPLTAHRVEIEGAEAYAVSGTPADCTGLGLSEALFPSLPDLVLSGINVGSNCGYNIVYSGTVAGAREAFIYDVPSASISYDWKRGDINVNDFVLSAQACLPIINSMLSAIKNKTHPTNCFLNIDLPTDIANHKGYKLTTQGKSLCKMGWRQVEEEAQGAKMLSTMLMETESGVVSDNNDTSAHHSNDSRLFKREVRTVVVEEGTDLHFLREGYITVTPIGALSQVDVDCQNYYKEWLPKISSSL

SEQ ID NO: 5494 - protein, 307 aa, Brassica napus
MAINGEDRISGERPIIMVTNDDGIDAPGLRSLVRVLVSTNLYDVRVCAPDSEKSAVSHSIIWSRPLTAHRVEIEGAEAYAVSGTPADCTGLGLSEALFPSLPDLVLSGINVGSNCGYNIVYSGTVAGAREAFIYDVPSASISYDWKRGDINVNDFVLSAQACLPIINGMLSAIKNKTHPTNCFLNIDLPTDIANHKGYKLTTQGKSLCKMGWRQVEEEAQGAKMLSTMSMETDSGVVSDNNDTSAHHSNDSRLFKREVRTVVVEEGTDLHFLREGYITVTPIGALSQVDVDCQNYYKEWLPKISSSL

SEQ ID NO: 5495 - protein, 314 aa, Brassica rapa
RLKITEAMAINGEDRISGERPIIMVTNDDGIDAPGLRSLVRVLVSTNLYDVRVCAPDSEKSAVSHSIIWSRPLTAHRVEIEGAEAYAVSGTPADCTGLGLSEALFPSLPDLVLSGINVGSNCGYNIVYSGTVAGAREAFIYDVPSASISYDWKRGDINVNDFVLSAQACLPIINGMLSAIKNKTHPTNCFLNIDLPTDIANHKGYKLTIQGKSLGKMGWRQVEEEAQGAKMLSTMSMETDSGVVSDNNDTSAHHSNDSRLFKRELRTVVVEEGTDLHFLREGYITVTPIGALSQVDVDCQNYYKEWLPKISSSL

SEQ ID NO: 5496 - protein, 942 aa, Arabidopsis lyrata
MEGFLTDEQREMMKKATQTADDLPPSQKPHSVLLEHLPKVSAGGKASGASNAVKHRRSHAGRSTRSKKDGCGGKGNWGKLIDTDGDYHIDRNDPNYDSGEEPFELVGATLSDPLDDYKKAAASIINEYFSTGDVDVAAADLIELGSSEYHPYFIKRLVSVAMDRHDKEKEMASVLLSALYADVINPNQIRDGFVLLLESADDFVVDIPDAVNVLALFLARAVVDDILPPAFLPRAAKALPVTSKGYQVVQTAEKSYLSAAHHAELVERRWGGQTRTTVEEVKKKIADILNEYVETGETYEACRCVRELGVSFFHHEVVKRALVTAMENHAAEGLVLKLLKEAASENLISSSQMVKGFSRLRESLDDLALDIPSARTKFDLIVPKAVSGGWLDASFGYPSGECGRQQIEDEKLKRFKEDIVTIIHEYFNSDDIPELIRSLEDLGAPEYNPIFLKKLITLALDRKNHEKEMASVLLSSLHIEMFTTEDVADGFVMLLESAEDTALDILDASNELALFLARAVIDDVLAPFNLEEICSKLRPNSSGTETVKMARSLIFARHAGERLLRCWGGGSGWAVEDAKDKISNLLEEYESSGLVSEACKCIHELGMPFFNHEVVKKALVMGMEKKKDKMMLDLLQESFGEGLITTNQMTKGFTRVKDGLEDLALDIPNAKEKFKDYVEHGKKNGWRQQESEVSKLKMKFVIPKLPFTLSLLLSLSLLIIFLFAFPTTFLRRPLSSSVIAVADEGIRIRHHGYSSYEAYIKHQLNKTQNPKLRKVWTTRDWDRKVRVFSTFFRRLSDRGLLSNQSKALSIGARVGQEVAALRLIGVEDSVGIDLVPRPPLVVKGDFHAQPFDEETFDFEFSNVFDHALYPEKFVGEIERTLKPGGVCVLHVSISGKTDKYSANDLFSVKPLVNLFKRSKVVEMRKIDGFGLDTEIVFRKNIN

SEQ ID NO: 5497 - protein, 171 aa, Arabidopsis thaliana
MLSPIENERSEIPSPEKLKLVEEPSDDESKFSNYDSDDWETLSDDLRLLDEEWGKSGGFDVDFSKVRHRFGCGAVHLDDDNMVSEPHETNRDLLNRLSNMAISFYNDKTDSSLELVKVLRANFHPSAAITLYITFEANDPKDGNQTKRYQAVVLYLSFDIQVCSCKPEPSS

SEQ ID NO: 5498 - protein, 276 aa, Arabidopsis lyrata
MRTLISPSLAPFSLHLPKPSLFSTALRFSSLTTSTISINNRSPTNAPPSAISTRKLQTKATAPLSFTTPGEIHVVVGPMFSGKTTTLLRRILAEKETGKQIAIIKSNKDTRYCTESIVTHDGEKFPCWSLPDLSSFKERFGFDEYENRLDVIGIDEAQFFGDLYEFCRQAADREGKTVIVAGLDGDFKRRRFGSVLDLIPIADTVTKLTSRCEVCGKRALFTMRKTEEKETELIGGAEVYMPVCRSHYVCGQSVLETARAVLDSSSNKHDVVASLL

SEQ ID NO: 5499 - protein, 345 aa, Brassica napus
TGFYSDQLDPNWVVDPQHLFVGPKIGEGSHAKIYEGKYKNKTVAIKIIKKGESPEEIAKRDSRFAREVSMLSKVQHKNLVKFIGACKEPIMVIVTELLLGGTLRKYLVSLRPGRLDIRLAVGFALDIARAMECLHSHGIIHRDLKPENLILTSDYKTVKLADFGLAREESLTEMMTAETGTYRWMAPELYSTVTLRQGEKKHYNHKVDAYSFAIVLWELIHNKLPFEGMSNLQAAYAAAFKNVRPSADDLPEDLAMIVTSCWKEDPNDRPNFTEIIQLLLRYLSTISAPELVPPSMKRVFSSENTVLPPESPRTCSLMAVRDGDQITTDTNSPEKEGRGSFFFCC

SEQ ID NO: 5500 - protein, 190 aa, Raphanus sativus
MGSGTGFYSDQLDPKWVVDPQHLFVGPKIGEGSHAKIYEGEYKNKTVAIKIIKKGESPEEIAKRDSRFAREVSMLSRVQHKNLVKFIGACKEPIMVIVTELLLGGTLRKYLVSLRPGRLDTRLAVGFALDIARAMECLHSHGIIHRDLKPENLILTADYKTVKLADFGLAREITNRDDDCRNWYLSLDGS

SEQ ID NO: 5501 - protein, 352 aa, Prunus persica
MGSGNGVYSVGDFNLDAKWLIDPKLLFVGPRIGEGAHAKVYEGKYKNQTVAVKIVHRGETPEEIAKRESRFAREVAMLSKVQHKNLVKFIGACKEPVMVIVTELLLGGTLRKYLFSMRPRCLDICVAVGFALDIARAMECLHSHGIIHRDLKPENLILTADHKTVKLADFGLAREESLTEMMTAETGTYRWMAPELYSTVTLRHGEKKHYNHKVDAYSFAIVLWELIHNKLPFEGMSNLQAAYAAAFKNVRPSAENLPEDLALIVTSCWKEDPNDRPNFTQIIQMLLHYLSTISAPEPAIPQRIFRSENAVLPPESPGTSSLMTTHDDSGETPKIDVEEKPKGFSFCFSQCY

SEQ ID NO: 5502 - protein, 351 aa, Populus trichocarpa
MGSSNGFYSEEFDLDAKWLIDPKLLFVGPKIGEGAHAKVYEGKYKNQIVAIKIVHGGETPEEIAKREARFAREVAMLSRVQHKNLVKFIGACKEPVMVIVTELLLGGTLRKYLLNMRPRCLDMRLAVGFALDIARAMECLHSHGIIHRDLKPENLILTADHKTVKLADFGLAREESLTEMMTAETGTYRWMAPELYSTVTLRHGEKKHYNHKVDAYSFAIVLWELIHNKLPFEGMSNLQAAYAAAFKNVRPSAENLPEDLALIVTSCWKEDPNARPNFSQIIQMLLHYLSTISAPKPVIPARIFTSENAVLPPESPGTSSLMAVRDDLGETPRTQIEDKPKSFFFCFNQCY

SEQ ID NO: 5503 - protein, 353 aa, Ricinus communis
MGSTDNGFYSGEFNLDAKWLIDPKLLLVGPKIGEGAHAKVYEGKYKNRIVAIKVVHRGETPEEIAKREARFAREVAMLSRVQHKNLVKFIGACKEPVMVIVTELLLGGTLRKYLLNLRPRSLELHVAIGFALDIARAMECLHSHGIIHRDLKPENLILTADHKTVKLADFGLAREESLTEMMTAETGTYRWMAPELYSTVTLRHGEKKHYNHKVDAYSFAIVLWELIHNKLPFEGMSNLQAAYAAAFKNVRPSADDLPEEMAMIVTSCWQEDPNARPNFTQIIQMLLRFLSTISPPEPVIPARIFTSENAVLPPESPGTSSLMAVRDDSGETPKSKMEDNKPRGFFFCFNQCY

SEQ ID NO: 5504 - protein, 351 aa, Populus trichocarpa
MGSSNVFYSGEFNLDAKWLVDPKLLFVGPKIGEGAHAKVYEGKYKNQNVAIKIVHGGETPEEIAKRQARFAREVAMLSRVQHKNLVKFIGACKEPVMVIVTELLLGGTLRKYLLNMRPRCLEMRVAFGFALDIARAMECLHSHGIIHRDLKPENLILTADHKTVKLADFGLAREESLTEMMTAETGTYRWMAPELYSTVTLRHGEKKHYNHKVDAYSFAIVLWELIHNKLPFEGMSNLQAAYAAAFKNVRPSAENLPEDLALIVTSCWKEDPNARPNFSQIIQMLLHYLSTISAPEPAIPARIFTSENAVFPPESPGTSSLMAVRDDSGETPRTQIEDKPRGFFFCFNQCY

SEQ ID NO: 5505 - protein, 690 aa, Arabidopsis lyrata
MAKTIQAIITICSLLLLLLLSATTSHPLCSDSKTPVNNNETLQFCDSYKGKSCCNSKDDLQLQNRFNSMNISDSNCSSLLKSILCSKCDQSSGQLFDDDSSLVPILCNSTSQDLCSKLWDSCQNISIVSSPFSPTLLGGATSPSTSSNSSTLTDLWKSQTEFCTAFGGPSQTNNNKTKCFNGEPVNKDTDVKPPKGVCLEKIGTGSYLNMVAHPDGSNRAFFSNQPGKIWLGTIPDQDSGEPMEIDESTPFVDITDQVSFDTQFGMMGMAFHPKFAENGRFFASFNCDKVKSPGCSGRCACNSDVNCDPSKLPKDDGAHPCRYQTVVAEYTANGTSSSPSTAKIGKASEVRRIFTLGLPYSSSHGGQILFGPDGYLYLMTGDGGGVSDTHNFAQNKKSLLGKILRLDVDVMPSVSEISKLGLWGNYSIPKNNPFQGNENEQPEIWALGLRNPWRCSFDSERPDYFLCADVGKDTYEEVDIITKGGNYGWRTYEGPYVFSPLSPFGENVSADSNLTFPILGYNHSEVNKHEGSASIIGGYFYRSNTDPCSYGTYLYADLYANAMWAAIESPEDSGNFTDSLIPFSCSKDSPIKCTAAPGGASSGPALGYIYSFGQDNNKDIHLLTSSGVYRVVRPSRCNLACSKENTTASTGKQNPAGAAPPQPLPSSARKLCFSLFLLVSLLFMFLTVLD

SEQ ID NO: 5506 - protein, 345 aa, Arabidopsis thaliana
MAEANERSKEMARSNSCVFPRDLLQRFISNSVEGEDDDEEEDDDEIELNLGLSLGGRFGVDKSNKLVRSSSVVVTMPLFREDHHHHQAAAMITTKVSTETVAGATRGTGLMRTTSLPAESEEEWRKRKEMQTLRRMAAKRRRSEKLRTGVGGGNSNNPEEAATATASRRRGRPSSGLPRWSATANKSGLLRQHSAGLDSLQVSGESLGGGRAAGSSSSVSELETKASSDEARSLPSTTQPQQETTTKPTNRLRRLSSVDMNMKMEPQGKGKSEMPCVFTKGDGPNGKRVDGILYRYGSGEEVRIMCVCHGDFLSPADFVKHAGGPHVDHPLRHIVVNTSSPSNLL

SEQ ID NO: 5507 - protein, 341 aa, Arabidopsis lyrata
MARSNSCVFPRDLLQRFISNSVEGEDDDEEEEDDEIELNLGLSLGGRFGVDKSNNNKLVRSSSVVVTMPLFREDHHHHQAAAMITTKVSTETVAGATRGTGLMRTTSLPAESEEEWRKRKEMQTLRRMAAKRRRSEKLRTVAVAGGGNSNNPEEAVTATTSRRRGRPSSGLPRWSATANKSELLRQHSAALDSLQVSVESQGGGGGGGAAGSSSSVSELETKASSDEARSLPSTTQQQETTTKPTNRLRRLSSVDMNMKMEPQGKGKSEMPCVFTKGDGPNGKRVDGILYRYGNGEEVRIMCVCHGDFLSPADFVIHAGGPHVDHPLRHIVVNTSSPSNLL

SEQ ID NO: 5508 - protein, 565 aa, Brassica napus
MVVFGNVSAANLPYQNGFLKAISSGGCDLMGHRSFKISTCFKTRTRRRRSAGPLQVVCVDIPRPELENTVNFLEAASLSASFRSAPRPAKPLKVVIAGAGLAGLSTAKYLADAGHKPLLLEARDVLGGKIAAWKDEDGDWYETGLHIFFGAYPNVQNLFGELGINDRLQWKEHSMIFAMPSKPGEFSRFDFPDVLPAPLNGIWAILRNNEMLTWPEKIKFAIGLLPAMVGGQAYVEAQDGLSVEQWMRKQGVPDRVTDEVFIAMSKALNFINPDELSMQCILIALNRFLQEKHGSKMAFLDGNPPERLCMPIVEHIRSLGGEVRLNSRIRKIELEDDGTVKSFLLTDGTTIQGDAYVFATPVDILKLLLPDSWKEIPYFKRLEKLVGVPVINVHIWFDRKLKNTYDHLLFSRSNLLSVYADMSLTCKEYYDPNRSMLELVFAPAEEWISRTDSDIIDATMKELERLFPDEIAADQSKAKILKYHVVKTPRSVYKTIPDCEPCRPLQRSPIKGFYLAGDYTKQKYLASMEGAVLSGKFCSQSILKDYELLAASSGPQKLSEATLST

SEQ ID NO: 5509 - protein, 565 aa, Brassica rapa
MVVFGNVSAANLPYQNGFLKAISSGGCDLMGHRSFKISTSFKTRTRRRRSAGPLQVVCVDIPRPELENTVNFLEAASLSASFRSAPRPAKPLKVVIAGAGLAGLSTAKYLADAGHKPLLLEARDVLGGKIAAWKDEDGDWYETGLHIFFGAYPNVQNLFGELGINDRLQWKEHSMIFAMPSKPGEFSRFDFPDVLPAPLNGIWAILRNNEMLTWPEKIKFAIGLLPAMVGGQAYVEAQDGLSVEQWMRKQGVPDRVTDEVFIAMSKALNFINPDELSMQCILIALNRFLQEKHGSKMAFLDGNPPERLCMPIVEHIRSLGGEVRLNSRIRKIELEDDGTVKSFLLTDGTTIQGDAYVFATPVDILKLLLPDSWKEIPYFKRLEKLVGVPVINVHIWFDKKLKNTYDHLLFSRSNLLSVYADMSLTCKEYYDPNRSMLELVFAPAEEWISRSDSDIIDATMKELERLFPDEIAADQSKAKILKYHVVKTPRSVYKTIPDCEPCRPLQRSPIKGFYLAGDYTKQKYLASMEGAVLSGKFCSQSILQDYELLAASSGPQKLSETTLST

SEQ ID NO: 5510 - protein, 563 aa, Brassica napus
MVVFGNVSAANLPYQNVFLEALSSELMGHSSFRVPISSQALKTRTRRRTAGPLQVVCVDIPRPELENTVNFLEAASLSASFRSAPRPAKPLKVVIAGAGLAGLSTAKYLADAGHQPLLLEARDVLGGKIAAWKDEDGDWYETGLHIFFGAYPNVQNLFGELGINDRLQWKEHSMIFAMPSKPGEFSRFDFPDVLPAPLNGIWAILRNNEMLTWPEKIKFAIGLLPAMVGGQAYVEAQDGLSVEEWMRKQGVPDRVTDEVFIAMSKALNFINPNELSMQCILIALNRFLQEKHGSKMAFLDGNPPERLCMPIVEHIRSLGGEVRLNSRIRKIELEDDGTVKNFLLTDGTTIQGDAYVFATPVDILKLLLPDSWKEISYFKRLEKLVGVPVINVHIWFDRKLKNTYDHLLFSRSNLLSVYADMSLTCKEYYDPNRSMLELVFAPAEEWISRTDSDIIDATMKELEKLFPDEIAADQSKAKILKYHVVKTPRSVYKTIPDCEPCRPLQRSPIQGFYLAGDYTKQKYLASMEGAVLSGKFCSQSIVQDYELLAASGRRNLSETTVST

SEQ ID NO: 5511 - protein, 562 aa, Gossypium hirsutum
MSLCGSVSALYLNLQSSKISMGNVLAFRSGESMGNTLRIPFKKRSRKGAGCPLQVVCIDYPRPELENTVNFLEAASLSASFRSASRPTKPLKVIIAGAGLAGLSTAKYLADAGHTPILLEARDVLGGKVAAWKDDDGDWYETGLHIFFGAYPNVQNLFGELGINDRLQWKEHSMIFAMPNKPGEFSRFDFPEVLPAPLNGIWAILKNNEMLTWPEKVKFAIGLLPAMLGGQPYVEAQDGLSVKDWMRKQGVPDRVTEEVFIAMSKALNFINPDELSMQCILIALNRFLQEKHGSKMAFLDGNPPERLCMPIVNHIESLGGEVRLNSRIKKIELNEDGTVKTFLLNNGNTIEGDAYVVATPVDIFKLLLPEDWREISYFKKLEKLVGVPVINVHIWFDRKLKNTYDHLLFSRSPLLSVYADMSVTCKEYYNPNQSMLELVFAPAEEWIACSDSEIIDATMKELAKLFPDEISADQSKAKVVKYHIVKTPRSVYKTVPNCEPCRPLQRSPIQGFYLAGDYTKQKYLASMEGAVLSGKLCAQSIVQDYELLCTLGQRKLTGASIH

SEQ ID NO: 5512 - protein, 570 aa, Helianthus annuus
MSLLGNVSATGNSVVMSSSLSRDYFANTTSGRTDVLSFRHGDIMGHRLQFRSRTNKITVCPFKVVCVDYPRPELDNTSNFLEAAYLSSTFPTAPRPAKPLNVVIAGAGLAGLSTAKYLADAGHKPILLEARDVLGGKVAAWKDQDGDWYETGLHIFFGAYPNVQNLFGELGINDRLQWKEHSMIFAMPNKPGEFSRFDFPDVLPAPINGIWAILRNNEMLTWPEKVKFAIGLLPAMLGGQAYVEAQDGLSVQDWMRKQGIPDRVTTEVFIAMSKALNFINPDELSMQCILIALNRFLQEKHGSKMAFLDGSPPERLCKPIVDHIESLGGQVRLNSRIQKIELNKDGTVKNFLLTDGNTIKGDAYVFATPVDILKLLLPEDWKPLPYFKKLDKLVGVPVINVHIWFDRKLKNTYDHLLFSRSPLLSVYADMSVTCKEYYDPNRSMLELVFAPAEEWIARSDSDIIDATMSELSKLFPDEIAADGSKAKILKYHVVKTPRSVYKTVPDCEPCRPLQRSPIEGFYLAGDYTKQKYLASMEGAVLSGKFCARAIVQDYELLAARGEVMAEASLV

SEQ ID NO: 5513 - protein, 580 aa, Centaurea maculosa
  misc_feature (11)..(11): Xaa can be any naturally occurring amino acid
  misc_feature (262)..(262): Xaa can be any naturally occurring amino acid
MSLFGNVSAIXSSGKCTVMNLSSTPPINCFNNISSGKTDVLAFGRSDAMGQRLQFPCVPSFITRTKKNVSPLKVVCIDYPRPELDNTSNFLEAAYLSSTFRTSPRPAKPLKIVIAGAGLAGLSTAKYLADAGHKPILLEARDVLGGKVAAWKDDDGDWYETGLHIFFGAYPNVQNLFGELGINDRLQWKEHSMIFAMPNKPGEFSRFDFPDVLPAPLNGIWAILRNNEMLTWPEKVKFAIGLLPAMLGGQAYVEAQDGLSVXDWMRKQGIPDRVTTEVFIAMSKALNFINPDELSMQCILIALNRFLQEKHGSKMAFLDGSPPERLCMPIVEHIESLGGQVRLNSRIQKIELNKDGTVKNFLLSDGNIIEGDAYVFATPVDILKLLLPEDWKSIAYFKKLEKLVGVPVINVHIWFDRKLKNTYDHLLFSRSKLLSVYADMSVTCKEYYDPNRSMLELVFAPAEEWISRSDSDIIDATMSELSRLFPDEIAADQSKAKILKYHVVKTPRSVYKTVPDCEPCRPLQRSPIEGFYLAGDYTKQKYLASMEGAVLSGKFCAQAILQDYELLAARGEVVAEASLV

SEQ ID NO: 5514 - protein, 571 aa, Artemisia annua
  misc_feature (227)..(227): Xaa can be any naturally occurring amino acid
MSVSGNVSASLVSTITSRNDSINITSSSAKLLSFRRAVGHHFPLARSYSYSTKTRRRRNVSPLKVVCVDYPRPDLDNTSNFLEAAYLSSTFRVSPRPSKPLNIVIAGAGLAGLSTAKYLADAGHKPILLEARDVLGGKVAAWKDKDGDWYETGLHIFFGAYPNMQNLFGELGINDRLQWKEHSMIFAMPNKPGEFSRFDFPDVLPAPLNGIWAILRNNEMLTWPEKXKFAIGLLPAMLGGQAYVEAQDGLSVQDWMRQRGIPDRVTTEVFIAMSKALNFINPDELSMQCILIALNRFLQEKHGSKMAFLDGSPPERLCKPIVEHIESLGGQVRLNSRIQKIELNKDGTVRNFLLNDGNIIKGDAYVFAAPVDILKLLLPEDWKPIPYFKKLDKLVGVPVINVHIWFDRKLRNTYDHLLFSRSPLLSVYADMSVTCKEYYDPNRSMLELVFAPAEEWISRSDSDIIDATMSELSKLFPDEIAADQSKAKILKYHVVKTPRSVYKTVPDCEPCRPLQRSPIEGFYLAGDYTKQKYLASMEGAVLSGKFCAQAIVQDYELLAARGEVVAEASLV

SEQ ID NO: 5515 - protein, 580 aa, Manihot esculenta
MTLYGSVSALNLNWHCGTLAGRKLQSSLRCDYPSSSKQTNALAFRGSESMGHALRIPYGIATKTRTASRSLQVVCVDYPRPDIDNTVNFLEAAYLSASFRNSPRPAKPLKVVIAGAGLAGLSTAKYLADAGHKPVLLEAREVLGGKVAAWKDDDGDWYETGLHIFFGAYPNIQNLFGELGINDRLQWKEHSMIFAMPNKPGEFSRFDFAEVLPAPINGIWAILKNNEMLTWPEKVKFAIGLLPAMLGGQAYVEAQDGLTVQDWMRKQGVPDRVTKEVFIAMSKALNFINPDELSMQCILIALNRFLQEKHGSKMAFLDGNPPERLCMPIVDHIQSLGGEVRLNSRIKKIELNNDGTVKRFLLNSGETIEGDVYVFATPVDILKLLLPDDWKEIPYFKKLEKLVGVPVINVHIWFDRKLKNTYDHLLFSRSPLLSVYADMSVTCKEYYNPNQSMLELVFAPAEEWISCSDSEIIDATMRELSKLFPDEISADQSKAKIVKYHVVKTPRSVYKTVPNCEPCRPLQRSPIEGFYLAGDYTKQKYLASMEGAVLSGKLCTQSIVQDYELLVAREQRKLAEATIS

SEQ ID NO: 5516 - protein, 562 aa, Gossypium hirsutum
  misc_feature (115)..(115): Xaa can be any naturally occurring amino acid
  misc_feature (197)..(198): Xaa can be any naturally occurring amino acid
  misc_feature (237)..(237): Xaa can be any naturally occurring amino acid
  misc_feature (301)..(301): Xaa can be any naturally occurring amino acid
  misc_feature (303)..(304): Xaa can be any naturally occurring amino acid
  misc_feature (316)..(316): Xaa can be any naturally occurring amino acid
MSLCGSVSALYLNLQSSKISMGNVLAFRSGESMGNTLRIPFKKRSRKGAGCPLQVVCIDYPRPELENTVNFLEAASLSASFRSASRPTKPLKVIIAGAGLAGLSTAKYLADAGHXPILLEARDVLGGKVAAWKDDDGDWYETGLHIFFGAYPNVQNLFGELGINDRLQWKEHSMIFAMPNKPGEFSRFDFPEVLPAXXNGIWAILKNNEMLTWPEKVKFAIGLLPAMLGGQPYVEAXDGLSVKDWMRKQGVPDRVTEEVFIAMSKALNFINPDELSMQCILIALNRFLQEKHGSKMAFLDXNXXERLCMPIVNHIXSLGGEVRLNSRIKKIELNEDGTVKTFLLNNGNTIEGDAYVVATPVDIFKLLLPEDWREISYFKKLEKLVGVPVINVHIWFDRKLKNTYDHLLFSRSPLLSVYADMSVTCKEYYNPNQSMLELVFAPAEEWIACSDSEIIDATMKELAKLFPDEISADQSKAKVVKYHIVKTPRSVYKTVPNCEPCRPLQRSPIQGFYLAGDYTKQKYLASMEGAVLSGKLCAQSIVQDYELLRTLGQRKLTGASIH

SEQ ID NO: 5517 - protein, 364 aa, Cynara scolymus
  misc_feature (23)..(23): Xaa can be any naturally occurring amino acid
  misc_feature (25)..(25): Xaa can be any naturally occurring amino acid
  misc_feature (36)..(36): Xaa can be any naturally occurring amino acid
  misc_feature (71)..(71): Xaa can be any naturally occurring amino acid
  misc_feature (208)..(208): Xaa can be any naturally occurring amino acid
  misc_feature (364)..(364): Xaa can be any naturally occurring amino acid
MSLFGNVSTINSSGKCTIMNLSXTXISSRDCFNIAXGHMDVLAFGHSDAMGHPLRFPGVRSLITRTKKNVXPLKVVCVDYPRPELENTSNFLEAAYLSSTFRTSPRPAKPLEIVIAGAGLAGLSTAKYLADAGHKPILLEARDVLGGKVAAWKDDDGDWYETGLHIFFGAYPNVQNLFGELGINDRLQWKEHSMIFAMPNKPGEFSRXDFPDVLPAPLNGIWAILRNNEMLTWPEKVKFAIGLLPAMLGGQAYVEAQDGLSVKDWMRKQGIPDRVTTEVFIAMSKALNFINPDELSMQCILIALNRFLQEKHGSKMAFLDGSPPERLCMPVVEHIESLGGVVRLNSRIQKIELTKMELLGTSTX

SEQ ID NO: 5518 - protein, 543 aa, Artemisia annua
AKLLSFRRAVGHHFPLARSYSYSTKTRRRRNVSPLKVVCVDYPRPDLDNTSNFLEAAYLSSTFRVSPRPSKPLNIVIAGAGLAGLSTAKYLADAGHKPILLEARDVLGGKVAAWKDKDGDWYETGLHIFFGAYPNMQNLFGELGINDRLQWKEHSMIFAMPNKPGEFSRFDFPDVLPAPLNGIWAILRNNEMLTWPEKVKFAIGLLPAMLGGQAYVEAQDGLSVQDWMGQRGIPDRVTTEVFIAMSKALNFINPDELSMQCILIALNRFLQEKHGSKMAFLDGSPPERLCKPIVEHIESLGGQVRLNSRIQKIELNKDGTVRNFLLNDGNIIKGDAYVFAAPVDILKLLLPEDWKPIPYFKKLDKLVGVPVINVHIWFDRKLRNTYDHLLFSRSPLLSVYADMSVTCKEYYDPNRSMLELVFAPAEEWISRSDSDIIDATMSELSKLFPDEIAADQSKAKILKYHVVKTPRSVYKTVPDCEPCRPLQRSPIEGFYLAGDYTKQKYLASMEGAVLSGKFCAQAIVQDYELLAARGEVVAEASLV

SEQ ID NO: 5519 - protein, 570 aa, Helianthus annuus
MSLLGNVSATGNSVVMTSSLSRDYFANTTSGRTDVLSFRHGDIMGHRLQFRSRTNKITVCPFKVVCVDYPRPELDNTSNFLEAAYLSSTFPTAPRPAKPLNVVIAGAGLAGLSTAKYLADAGHKPILLEARDVLGGKVAAWKDQDGDWYETGLHIFFGAYPNVQNLFGELGINDRLQWKEHSMIFAMPNKPGEFSRFDFPDVLPAPINGIWAILRNNEMLTWPEKVKFAIGLLPAMLGGQAYVEAQDGLSVQDWMRKQGIPDRVTTEVFIAMSKALNFINPDELSMQCILIALNRFLQEKHGSKMAFLDGSPPERLCKPIVDHIESLGGQVRLNSRIQKIELNKDGTVKNFLLTDGNTIKGDAYVFATPVDILKLLLPEDWKPLPYFKKLDKLVGVPVINVHIWFDRKLKNTYDHLLFSRSPLLSVYADMSVTCKEYYDPNRSMLELVFAPAEEWIARSDSDIIDATMSELSKLFPDEIAEDGSKAKILKYHVVKTPRSVYKTVPDCEPCRPLQRSPIEGFYLAGDYTKQKYLASMEGAVLSGKFCARAIVQDYELLAARGEVMAEASLV

SEQ ID NO: 5520 - protein, 562 aa, Cichorium intybus
NLPNTQITTKDCFNITSGQKDVLSFGCCDAMGHRLQFPSARSFTSKSKKNISPLKAVCVDYPRPELENTSNFLEAAYLSSTFTTSPRPSKPLKIVIAGAGLAGLSTAKYLADAGHKPILLEARDVLGGKVAAWKDDDGDWYETGLHIFFGAYPNVQNLFGELGINDRLQWKEHSMIFAMPNKPGEFSRFDFPDVLPAPINGIWAILRNNEMLTWPEKVKFAIGLLPAMLGGQAYVEAQDGLSVQDWMRKQGIPDRVTTEVFIAMSKALNFINPDELSMQCILIALNRFLQEKHGSKMAFLDGSPPERLCQPIVDHIESLGGQVRLNSRIQKIELNKDGTVRNFLLNDGNVLEADAYVFATPVDILKLLLPEEWKPIPYFKKLEKLVGVPVINVHIWFDRKLKNTYDHLLFSRSPLLSVYADMSVTCKEYYDPNRSMLELVFAPAEEWISRSDSDIIDATMSELSRLFPDEISADGSKAKILKYKVVKTPRSVYKTIPDCEPCRPLQRSPIEGFYLAGDYTKQKYLASMEGAVLSGKFCAQAIVKDYELLAARKGVVAEASLV

SEQ ID NO: 5521 - protein, 320 aa, Arabidopsis lyrata
MACQNNLVVKQIVDLYDQISKLVSLKPSKNVDTLFGQLVSTCLPTDTNIDVTNMCEEVKYMRSNLIKLCGEAEGYLEQHFSTILGSLQEDQNPLDHLHIFPYYTNYLKLGKLEFDLLSQHSSHVPTKIAFVGSGPMPLTSIVLAKFHLPNTTFHNFDIDSHANTLASNLVSRDPDLSKRMIFHTTDVLNATEGLDQYDVVFLAALVGMDKESKVKAIEHLEKHMAPGAVLMLRSAHALRAFLYPIVDSSDLKGFQLLTIYHPTDDVVNSVVIARKLGGSTTTGVNGTRGCMFMPCNCSKIHAIMNNRGKKNIIEEFSAIE

SEQ ID NO: 5522 - protein, 320 aa, Arabidopsis thaliana
MACQNNLVVKQIIDLYDQISKLKSLKPSKNVDTLFGQLVSTCLPTDTNIDVTNMCEEVKDMRANLIKLCGEAEGYLEQHFSTILGSLQEDQNPLDHLHIFPYYSNYLKLGKLEFDLLSQHSSHVPTKIAFVGSGPMPLTSIVLAKFHLPNTTFHNFDIDSHANTLASNLVSRDPDLSKRMIFHTTDVLNATEGLDQYDVVFLAALVGMDKESKVKAIEHLEKHMAPGAVLMLRSAHALRAFLYPIVDSSDLKGFQLLTIYHPTDDVVNSVVIARKLGGPTTPGVNGTRGCMFMPCNCSKIHAIMNNRGKKNMIEEFSAIE

SEQ ID NO: 5523 - protein, 422 aa, Arabidopsis lyrata
MATLKCIDWQFSGSEAAKEAAGASLGTYTSALYALCDPSGKSILPPRNEILETSNTAEKAVVKAVLYGTGNAYAPSVGLATAKRAVADYLNQGLPKKLTADDVFMTLGCKQAIELAVDILAKPKANVLLPSPGFPWDLVRSIYRNLEVRHYDFLPQKNFEIDFDSVRALVDENTFAIFIINPHNPNGNTYSEAHLKQLAELAKELKIMVVSDEVFRWTLFGSNPFVPMGKFSSIVPVVTLGSISKGWKVPGWRTGWLALHDLDGVFRNTKILQAAQEYLQINNNPPTVIQAAIPDILEKTPKDFFDKRQSFLKDKVEFGYSKLKHIPSLTCYMKPEACTFLWTELDLSSFVDIEDDQDFCNKLAIEENLVVLPGIAFSQKNWLRHSIDMETPVLEDAMERLKSFCDRHSIKKAPLKDVNGVK

SEQ ID NO: 5524 - protein, 422 aa, Arabidopsis thaliana
MATLKCIDWQFSGSEAAKDAAAASLGSYTSALYALCDPHGKPILPPRNEILETSNTAEKAVVKAVLYGSGNAYAPSLGLAAAKSAVAEYLNQGLPKKLTADDVFMTLGCKQAIELAVDILAKPKANVLLPSPGFPWDLVRSIYKNLEVRHYNFLPEKNFEIDFDSVRALVDENTFAIFIINPHNPNGNTYSEAHLKQLAELAKELKIMVVSDEVFRWTLFGSNPFVPMGKFSSIVPVVTLGSISKGWKVPGWRTGWLTLHDLDGVFRNTKVLQAAQDFLQINNNPPTVIQAAIPDILEKTPQEFFDKRQSFLKDKVEFGYSKLKYIPSLTCYMKPEACTFLWTELDLSSFVDIEDDQDFCNKLAKEENLVVLPGIAFSQKNWLRHSIDMETPVLEDALERLKSFCDRHSNKKAPLKDVNGVK

SEQ ID NO: 5525 - protein, 93 aa, Brassica napus
GRLRTGPNSRVDPRVRKHIPQKHQTQTKEEEHNMVSQKLEICIELVKFAVVFVATVAESVEKAFRKPLPALPAVHDGSRNSYSAVPIPLVGFM

SEQ ID NO: 5526 - protein, 60 aa, Brassica napus
MVSQKLEICIELVKFAVVFVATVAESVEKAFRKPLPALPAVHDGSRNSYSAVPIPLVGFM

SEQ ID NO: 5527 - protein, 60 aa, Brassica juncea
MVSQKLEICIELVKFAVVFVATVTESVEKAFRKPLPALPAVHDGSRNSYSAVPIPLVGFM

SEQ ID NO: 5528 - protein, 60 aa, Arabidopsis lyrata
MVSQKLEICIELVKIAVGFVATVAESVEEAFRKPQPSLTAVHGGRRNTYAAVPIPLVGFM

SEQ ID NO: 5529 - protein, 60 aa, Arabidopsis thaliana
MVSQKLEICIELVKIAVVFVTTVAESVEEAFRKPPPSLPAVHGGRRNNYAAVPIPLVGFM

SEQ ID NO: 5530 - protein, 60 aa, Brassica napus
MVSQKLEICIELVKIGVVFVATVAESVEKAFRKPPPSLPAVHDSRRNSYADVPIPLVGFM

SEQ ID NO: 5531 - protein, 106 aa, Brassica napus
  misc_feature (2)..(2): Xaa can be any naturally occurring amino acid
IXKSQRQKFCRRGKHREKKHIPQKRNTQTRRRRKSTFRFLLQIKHNMVSQKLEICIELVKIGVVFVATVAESVEKAFRKPPPSLPAVHDSRRNSYADVPIPLVGFM

SEQ ID NO: 5532 - protein, 60 aa, Thellungiella halophila
MVSQKLEICIELMKIAVVFVATVAESVEEAFRKPLPALPAVHGGRRNSYANVPVPLVGFM

SEQ ID NO: 5533 - protein, 102 aa, Brassica juncea
AHKDKSSRDAENIERRNTLTSKAQYTEEKKYIFSFLLQINHNMVSQKLEICIELVKIGVVFVATVAESVEKAFRKPPQVLPAVHDGCQNSYADVPIPLVGFM

SEQ ID NO: 5534 - protein, 60 aa, Brassica juncea
MVSQKLEICIELVKIGVVFVATVAESVEKAFRKPPQVLPAVHDGCQNSYADVPIPLVGFM

SEQ ID NO: 5535 - protein, 97 aa, Brassica rapa
SRRGKNRVKEYIPQKRKKPNQRTESYIFIFLLQIKHSMVSQKLEFCIELVKMAVVFVAAVAESLEEAFRKPQPALPVVHDGRRNSYANVPIPLVGFM

SEQ ID NO: 5536 - protein, 57 aa, Brassica rapa
QKLEICIELVKIGVVFVATVAESVEKAFRKPPPSLPAVHDSRRNSYADVPIPLVGFM

SEQ ID NO: 5537 - protein, 60 aa, Raphanus sativus
MVSQKLEICIELVKTAVSFVATVAETVEEAFRKPPPALPSAHDVRRNSYADVPIPLVGFM

SEQ ID NO: 5538 - protein, 166 aa, Brassica napus
MSGSGAQLHNVFVYGSFQEPEVVKVMLDRSPEIISVTLPGFKRFRLKGRLYPCVIPSEDGEVHGKLLMGLTDEELENVDAVEGNEYERVTVGVVREDNSEKMTVKTYIWINKDDPDIDGEWDFEEWKRLHMKKFIETFKEIMEWKRNPQGKGRDDFNHVLRDAPSA

SEQ ID NO: 5539 - protein, 73 aa, Brassica napus
MLDRSPEIISVTLPGFKRFRLKGRLYPCVIPSEDGEVHGKLLMGLTDEELENVDAVEGNEYERVTVGVVRGQF

SEQ ID NO: 5540 - protein, 214 aa, Brassica napus
MATRGAAAAFVIWKHRNNPSLRSISSHHFYPIFKPQIIPKGCRYQIRAIQGESVDRGTQSKNNDEPKPKPENWKIKMLYDGDCPLCMREVNMLKERNEEYGTIKFVDISSNDYSPQENQGLDYKTVMGQIHAIQSEGNVVTGVEAFRKLYELVGLGWVYSITKFEPIGKVADAVYDFWAKYRLQVTGRPPIEAILEARKKNKVETCGNSKACKT

SEQ ID NO: 5541 - protein, 221 aa, Brassica rapa
KIGREYKMATRGAAAAFVIWKHRNNPSLRSISSHHFYPIFKPQMIPKGCRYQIRAIQGESVDRGTQSKSNDEPKPKPENWKIKMLYDGDCPLCMREVNMLKERNEEYGTIKFVDISSNDYSPQENQGLNYKTVMGQIHAIQSDGNVVTGVEAFRKLYELVGLGWVYSITKFEPIGKVADAVYDFWAKYRLQVTGRPPIEAILEARKKNKVETCGNSKACKT

SEQ ID NO: 5542 - protein, 226 aa, Brassica napus
  misc_feature (7)..(7): Xaa can be any naturally occurring amino acid
LAFERKXGREYKMATRGAAAAFVIWKHRNNPSLRSISSHHFYPIFKPQIIPKGCRYQIRAIQGESVDRGTQSKNNDEPKPKPENWKIKMLYDGDCPLCMREVNMLKERNEEYGTIKFVDISSNDYSPQENQGLDYKTVMGQIHAIQSEGNVVTGVEAFRKLYELVGLGWVYSITKFEPIGKVADAVYDFWAKYRLQVTGRPPIEAILEARKKNKVETCGNSKACKT

SEQ ID NO: 5543 - protein, 227 aa, Raphanus sativus
  misc_feature (11)..(11): Xaa can be any naturally occurring amino acid
KHILHLRKKLXENTKMATRGAAAAFVIWKHRSNPSLRSLSSHHFYPVFKPQIIPKGFRYQIRAIQGASVDPVTQLKNNDEPKPENWKIKMLYDGDCPLCMREVNMLKERNEENGTIKFVDISSDDYSPQENQGLDYKTVMGQIHAIQSDGNVVTGVEAFRKLYEEVGLGWVYTITKFEPIGKVADAVYDFWAKYRLQVTGRPPIEAILEARKKNKVETCGDSKACKT

SEQ ID NO: 5544 - protein, 223 aa, Brassica napus
MASNNSNDDLYAVLGLNKECTSTELRTAYKKLALIWHPDRCSSMGNMEFVDEAKKKFQAIQEAYSVLSDSNKRFLYDVGAYNSDDDVEDQNGMGDFLNEMAAMMNQSKPNDNSSGDSFEQLQDLFNEMFQGDAAAFPPSSSSFSASTFTSSCNFVFDTNYQQSPFGMGSMGTSDPFGFDSRSHTFSLGVEHQQDFKKGKNNGGRRNRRKNNAQSSNNYGVPTS

SEQ ID NO: 5545 - protein, 223 aa, Brassica rapa
MASNNGNDDLYAVLGLNKECTSTELRTAYKKLALRWHPDRCSSMGNLEFVDEAKKKFQAIQEAYSVLSDSNKRFLYDVGAYNSDDDVEDQNGMGDFLNEMAAMMNQSKPNENNSGDSFEQLQDLFNEMFQGDATAFPPSSSSFSASTFTSSCNFVFDTNYQQSPFGMGSMGTSDPFGFDSRSHTFSLGVEHQQDFKKGKNNGGRRNRRKNNAQSSNNYGVPTS

SEQ ID NO: 5546 - protein, 68 aa, Brassica napus
MASNNSNDDLYAVLGWNKECTSTELRTAYKKLALRWHPDRCSSMGNMEFVHEATQEISGYSRGLLCSV

SEQ ID NO: 5547 - protein, 223 aa, Brassica napus
MASNNGNDDLYAVLGLNKECTSTELRTAYKKLALRWHPDRCSSMGNMEFVDEAKKKFQAIQEAYSVLSDSNKRFLYDVGAYNSDDDVEDQNGMGDFLNEMAAMMNQSKPNENSSGDSFEQLQDLFNEMFQGDATAFPPSSSSFPASTFTSSCDFVFDTNYQQSPFGMSSMGTSDPFGFDSRSHTFSLGVEHQQDFKKGKNNGGRRNRRKNSTQSSNNYGVPTS

SEQ ID NO: 5548 - protein, 223 aa, Raphanus sativus
MTSNKGNNDDLYAVLGLNKECTTTELRTAYKKLALRWHPDRCSSMGNLEFVDQAKKKFQAIQEAYSVLSDSNKRFLYDVGAYNSDDDEADQNGMGDFLNEMAAMMNQSKPNENNSGDSFEQLQDLFNEMFQGDPTAFPPSSSSTFTSSCSFVFDTNGQQSPFETSSMMGRSDPFGFDSRSHTFSLGVEHQQDFKKGTKNNGGRRSRRKNNSQTSNNYGVSSTS

SEQ ID NO: 5549 - protein, 124 aa, Brassica oleracea
MASNNGNDDLYAVLGLNKECTSTELRTAYKKLALRWHPDRCSSMGNMEFVDEAKKKFQAIQEAYSVLSDSNKRFLYDVGAYNSDDDVEDQNGMGDFLNEMAAMMNQSKPNARLSSLVSFTLSLL

SEQ ID NO: 5550 - protein, 215 aa, Raphanus sativus
MTSNKSNNDDLYAVLGLNKECTTTEVRTAYKKLALRWHPDRCSSMGNLEFVEEAKKKFQAIQEAYSVLSDSNKRFLYDVGAYNSDDDEADQNGMGDFLSEMAAMMNQSKPNESNNSGDSFEQLQDLFNEMFQGDPTAFPSSSSTFTSSCSFVFDTNGQQSQFGRSDPFGFDSRSHTFSLGVEHQQDFKKGKNNGGGRRNRRKTQSSNNYGVSSTS

SEQ ID NO: 5551 - protein, 233 aa, Brassica rapa
MASNSNEKGNDDLYAVMGLKKECTTTELRSAYKKLALRWHPDRCSSMGDSEFVDESKKKFQAIQEAYSVLSDSNKRFLYDVGAYNSDDDDHDQNGMGDFLNEMATMMNQSKPSENNTGDSFEQLQDLFNEMFQGDASAFSSSSSSCNASTFTSSCSFVFDTNAQQSPFEHNSMGMNDPFAFDPRAHTFSLGVEHQQDFKKGKNNGGRRNRRKNNAQSATHETSSSNNYGVPTS

SEQ ID NO: 5552 - protein, 233 aa, Brassica napus
MASNSNEKGNDDLYAVMGLKKECTTTELRSAYKKLALRWHPDRCSSMGDSEFVDESKKKFQAIQEAYSVLSDSNKRFLYDVGAYNSDDDDHDQNGMGDFLNEMATMMNQSKPSENNTGDSFEQLQDLFNEMFQGDASAFSSSSSSCNASTFTSSCSFVFDTNTQQSPFETNSMGMNDPFAFDPRAHTFSLGVEHQQDFKKGKNNGGRRNRRKNNAQSATHETSSSNNYGVPTS

SEQ ID NO: 5553 - protein, 228 aa, Raphanus sativus
MASKGNDDLYGVLGLKKECTTTELRSAYKKLALRWHPDRCSSMGDSEFVDESKKKFQAIQEAYSVLSDSNKRFLYDVGAYNSDDDDHDQNGMGDFLNEMATMMNQSKPSENNSGDSFEQLQDLFNEMFQGDASAFSSSSSSSTFTSSCSFAFDTNVQQSPFVTNSMGTNDPFAFDPRAHHTFSLGVEHQQDFKKGKNNGGRRNRRKNNAQSGAHETSTSSNNYGVPTS

SEQ ID NO: 5554 - protein, 226 aa, Brassica juncea
MASKGNDDLYAVLGLKKECSTVELRSAYKKLALRWHPDRCSSMGDSEFVDESKKKFQAIQEAYSVLSDSNKRFLYDVGAYNNDDDDHDQNGMGDFLNEMATMMNQSKPSENNSGDSFEQLQDLFNEMFQGDASAFSSSSSSSTFTSSCTFVFDTNAQQSPFETNSMGINDPFAFDPRAHTFSLGVEHQQDFKKGKNNGGRRNRRKNNAQSATHETSSSNNYGVPTS

SEQ ID NO: 5555 - protein, 226 aa, Brassica juncea
  misc_feature (20)..(20): Xaa can be any naturally occurring amino acid
  misc_feature (22)..(22): Xaa can be any naturally occurring amino acid
MASKGNDDLYAVLGLKKECXTXELRSAYKKLALRWHPDRCSSMGDSEFVDESKKKFQAIQEAYSVLSDSNKRFLYDVGAYNSDDDDHDQNGMGDFLNEMATMMNQSKPSENNSGDSFEQLQDLFNEMFQGDASAFSSSSSSSTFTSSCTFVFDTNAQQSPFETNSMGINDPFAFDPRAHTFSLGVEHQHDFKKGKNNGGRRNRRKNNAQSATHETSSSNNYGVPTS

SEQ ID NO: 5556 - protein, 227 aa, Raphanus sativus
MASKGNDDLYGVLGLKKECTTTELRSAYKKLALRWHPDRCSSMGDSEFVDESKKKFQAIQEAYSVLSDSNKRFLYDVGAYNSDDDDHDQNGMGDFLNEMATMMNQSKPSENNSGDSFEQLQDLFNEMFQGDASAFSSSSSSSTFTSSCSFAFDTNVQQSPFETNSMGMNDPFAFDPRAHHTFSLGVEHQQDFKKGKNNGVRRNRRKNNAQSGAHETSSSNNYGVPTS

SEQ ID NO: 5557 - protein, 226 aa, Arabidopsis lyrata
MASNNSEKINDNLYAVLGLKKECSSTELRTAYKKLALRWHPDRCSSMEFVEEAKKKFQAIQEAYSVLSDSNKRFLYDVGAYNTDDDDQNGMGDFLNEMATMMNQSKPNENNTGDSFEQLQDLFNEMFQGDPAAFSSSSSCSTSTFTSSCSFVFDTNDQRSSPFETSSIGINNDPFRYDLRAHSFSLGVDHQQEFKKGKNNGGRRNRRKNNASHETSSSNNYGVPTS

SEQ ID NO: 5558 - protein, 227 aa, Raphanus sativus
MASKGNDDLYGVLGLKKECTTTELRSAYKKLALRWHPDRCSSMGDSEFVDESKKKFQAIQEAYSVLSDSNKRFLYDVGAYNSDDDDHDQNGMGDFLNEMATMMNQSKPSENNSGDSFEQLQDLFNEMFQGDASAFSSSSSSSTFTSSCSFAFDTNVQKSPFETNSRGMNDPFAFDPRAHHTFSLGVEHQQDFKKGKNNGVRRNRRKSNAQSGAHETSSSNNYGVPTS

SEQ ID NO: 5559 - protein, 48 aa, Raphanus sativus
MASKGNDDLYGVLGLKKECTTTELRSAYKKLALRWHPDRCSSMGIRSL

SEQ ID NO: 5560 - protein, 295 aa, Brassica napus
MPRYDDRYGNTRLYVGHLSSRTRTRDLERLFNRYGRVRDVDMKRDYAFVEFSDPRDADDARHYLDGRDFDGSRITVEFSRGAPRGSRDYDSRGPPPGSGRCFNCGLDGHWARDCTAGDWKNKCYRCGERGHIERNCKNSPKKLRRSGSYSRSPVRSRSPRRRRSPSRSRSLSRSRSYSRSRSPVKRRERSAEERSRSPKRMEDSLSPRGRDRSPIIDDEGSPRIIDGSPPPSPKLEKPAGSDHDGGSSPQDNGNGRNTVASPAVGRSADSPREDRSPVDDDYEANRASPRGSESP

SEQ ID NO: 5561 - protein, 295 aa, Brassica rapa
  misc_feature (283)..(283): Xaa can be any naturally occurring amino acid
MPRYDDRYGNTRLYVGHLSSRTRTRDLERLFNRYGRVRDVDMKRDYAFVEFSDPRDADDARHYLDGRDFDGSRITVEFSRGAPRGSRDYDSRGPPPGSGRCFNCGLDGHWARDCTAGDWKNKCYRCGERGHIERNCKNSPKKLRRSGSYSRSPVRSRSPRRRRSPSRSRSLSRSRSYSRSRSPVKRRERSVEERSRSPKRMEDSLSPRGRDRSPIMDDEGSPRIIDGSPPPSPKLEKPAGSDHDGGSSPQDNGNGRNTVASPAVGRSADSPREDRSPVDDDYXANRASPRGSESP

SEQ ID NO: 5562 - protein, 247 aa, Brassica rapa
MPRYDDRYGNTRLYVGHLSSRTRTRDLERLFNRYGRVRDVDMKRDYAFVEFSDPRDADDARHYLDGRDFDGSRITVEFSRGAPRGSRDYDSRGPPPGSGRCFNCGLDGHWARDCTAGDWKNKCYRCGERGHIERNCKNSPKKLRRSGSYSRSPVRSRSPRRRRSPSRSRSLSRSRSYSRSRSPVKRRERSAEERSRSPKRMEDSLSPRGRDRSPIMDDEGSPRIIDGTPPPSPKLEKPAGSDHDGGS

SEQ ID NO: 5563 - protein, 1344 aa, Glycine max
RLHGNVETMAVLSIGGGDVSRKRDSIILTFADAKISVLEYDDSIHGLRTSSLHCFEGPEWLHLKRGREQFARGPVVKIDPQGRCGGVLIYDLQMIILKATQVGSGLVGDDDAFGSSGAVAARIESSYMINLRDLDMRHVKDFTFVYGYIEPVMVILHERELTWAGRVSWTHHTCMISALSISTTLKQHPLIWSAVNLPHDAYKLLAVPSPIGGVLVIGANTIHYHSQSASCALALNNYAVTLDSSQEIPRSSFNVELDAANATWLLSDVALLSTKTGELLLLMLVYDGRVVQRLDLSKSKASVLSSGITTIGNSLFFLASRLGDSMLVQFSCGSGVSMMSSNLKEEVGDIEVDAPSKRLRRSPSDALQDMVSGEELSLYGSATNRTESAQKSFSFAVRDSLINVGPLKDFSYGLRINADANATGIAKQSNYELVCCSGHGKNGSLCVLRQSIRPEVITEVELPGCKGIWTVYHKSTRSHNADSSKMADDDDEYHAYLIISLEARTMVLETADLLSEVTESVDYYVQGKTLAAGNLFGRRRVIQVYERGARILDGSFMTQDVSFGASNSESGSASESAIALSVSIADPFVLLRMSDGSIRLLIGDPSTCTISVTSPASFESSKGSVSSCTLYHDKGPEPWLRKTSTDAWLSTGVGEAIDGTDGAAQDHGDIYCVVCFDNGNLEIFDIPNFNCVFSVENFMSGKSHLVDALMKEVLKDSKQGDRDGVVNQGRKDNIPNMKVVELAMQRWSGQHSRPFLFGILSDGTILCYHAYLYESPDGTSKVEDSASAGGSIGLSSTNVSRLRNLRFVRVPLDAYPREDTSNGSPCQQITIFKNIGSYQGFFLSGSRPAWVMVLRERLRVHPQLCDGSIVAFTVLHNVNCNHGLIYVTSQGVLKICQLPSGSNYDSYWPVQKIPLKATPHQVTYFAEKNLYPLIVSFPVLKPLNQVISLVDQDFNHQNESQNMNPDEQNRFYPIDEFEVRIMEPEKSGGPWQTKATIPMQSSENALTVRMVTLLNTTSKENETLLAIGTAYVQGEDVAARGRILLFSLGKITDNPQTLVSEVYSKELKGAISALASLQGHLLIASGPKIILHKWNGTELNGIAFFDAPPLHVVSLNIVKNFILIGDIHKSIYFLSWKEQGAQLSLLAKDFGSLDCFATEFLIDGSTLSLMVSDDNRNIQIFYYAPKMSESWKGQKLLSRAEFHVGAHVTKFLRLQMLSTSDRAGSVPGSDKTNRFALLFGTLDGSIGCIAPLDEITFRRLQSLQRKLVDAVPHVAGLNPRAFRLFRSNGKAHRPGPDSIVDCELLCHYEMLPLEEQLEIANQIGTTRSQILSNLSDLSLGTSFL

SEQ ID NO: 5564 - protein, 500 aa, Quercus alba
RVRWFMVFRERLRVHPQLCDGSIVAFTVLHNVNCNHGLIYVTSQGILKICQLPSVSSYDNYWPVQKIPLKGTPHQVTYLAEKNLYPLIVSVPVHKSLNQVLSTLVDQEVGHQVENLNLGSDELHQTYTLDEFEVRILEPEKSGGPWQTKATIPMQSSENALTVRVVTLLNTTTKENETLLAIGTGYVQGEDVAARGRVLLFSVGKNTDNPQNLVSEVYSKELKGAISALASLQGHLLIASGPKIILHKWTGTELNGVAFFDAPPLYVVSLNIVKNFILLGDIHKSIYFLSWKEQGAQLSLLAKDFGSLDCFATEFLIDGSTLSLTVSDDQKNIQIFYYAPKMSESWKGQKLLSRAEFHVGAHVTKFLRLQMLSASSDRTGAAPGSDKTNRFALLFGTLDGSIGCIAPLDELTFRRLQSLQRKLVDAVAHVAGLNPKSFRQFRSNGKAHRPGPDSIVDCELLCHYEMLPLEEQLEIANQIGTTRSQILSNLTDLSLGTSFL

SEQ ID NO: 5565 - protein, 175 aa, Gossypium hirsutum
MVSDDQKNIQVFYYAPKMSESWRGQKLLSRAEFHVGAHVTKFLRLQMLSTSGRTSATAGSDKTNRFALLFGTLDGSIGCIAPLDELTFRRLQSLQKKLVDAVPHVAGLNPRSFRHFRSNGKAHRPGPDSIVDCELLCHYEMLPLEEQLEIAHQIGTTRSQILSNLNDLTLGTSFL

SEQ ID NO: 5566 - protein, 671 aa, Citrus sinensis
  misc_feature (3)..(3): Xaa can be any naturally occurring amino acid
  misc_feature (309)..(309): Xaa can be any naturally occurring amino acid
  misc_feature (410)..(410): Xaa can be any naturally occurring amino acid
  misc_feature (418)..(418): Xaa can be any naturally occurring amino acid
CLXIFDVPNFNCLFTVDKFVSGRTHIVDTYMREALKDSETEINSSSEEGTGQGRKENIHSMKVVELAMQRWSGHHSRPFLFAILTDGTILCYQAYLFEGSENTSKSDDPVSTSRSLSVSNVSASRLRNLRFSRTPLDAYTREETPHGAPCQRITIFKNISGHQGFFLSGSRPCWCMVFRERLRVHPQLCDGSIVAFTVLHNVNCNHGFIYVTSQGILKICQLPSGSTYDNYWPVQKVIPLKATPHQITYFAEKNLYPLIVSVPVLKPLNQVLSLLIDQEVGHQIDNHNLSSVDLHRTYTVEEYEVRILXPDRAGGPWQTRATIPMQSSENALTVRVVTLFNTTTKENDTLLAIGTAYVQGEDVAARGRVLLFSTGRNADNPQNLVTEVYSKELKGAISALASLQGHLLIXSGPKIILXKWTGTELNGIAFYDAPPLYVVSLNIVKNFILLGDIHKSIYFLSWKEQGAQLNLLAKDFGSLDCFATEFLIDGSTLSLVVSDEQKNIQIFYYAPKMSESWKGQKLLSRAEFHVGAHVTKFLRLQMLATSSDRTGAAPGSDKTNRFALLFGTLDGSIGCIAPLDELTFRRLQSLQKKLVDSVPHVAGLNPRSFRQFHSNGKAHRPGPDSIVDCELLSHYEMLPLEEQLEIAHQTGTTRSQILSNLNDLALGTSFL

SEQ ID NO: 5567 - protein, 1454 aa, Manihot esculenta
MSFAAYKMMHWPTGIENCASGFITHCRADLAPQVPSMQSDDLESEWPAKRGIGPVPNLIVTAGNVLEVYVIRVQEEGTRESRNSREPKRGGVMDGVSGASLELVCHYRLHGNVESMAVLPIEGGDGSRRRDSIILSFKDAKISVLEFDDSIHGLRTSSMHCFEGPEWLHLKRGRESFARGPSVKVDPQGRCGGVLVYDLQMIILKAAQAAAGLVGDDDALGSGGAISTRVQSSYIINLRDLDMKHVKDFIFVHEYIEPVVVILHERELTWAGRVSWKHHTCMISALSISTTLKQPTLIWSVVNLPHDAYKLLAVPSPIGGVLVICTNTIHYHSESATCALSLNNYAVSIDSSQELPRASFSVELDAAKATWLSNDVALLSTKNGELLLLTLVYDGRVVQRLDLSKSRASVLTSDITTIGSSLFFLGSRLGDSLLVQFTYGLGSSMISSGLKEEVGDIEGDVPTAKRLKRSPSDGLQDMVSGEELSLYGSTGNNTESTQKTFSFAVRDSLINVGPLKDLSYGLRVNADANASGIAKQSNYELVCCSGHGKNGALCVLRQSIRPEMITEVDLPGCRGIWTVYHKTARGHSVDTSRMAAVDDEYHAYLIISMENRTMVLETADHLTEVTESVDYFVQGRTIAAGNLFGRRRVVQVYERGARILDGSFMTQDLSFGASNSESGSGSDSSTVLSVSIADPYVLIRMTDGSIRLLVGDPSTCMVSINTPSAFENSKKSISACTLYHDKGPEPWLRKASTDAWLSTGISEAIDGADGGPHDQGDIYCILCYATGALEIFDVPNFNSVFSVDKFVSGKNHLVDTYVRETSKDSQQNKTSEEVAGLGRKESTHNMKVVELAMQISPGQHCRPFLFGILSDGTILCYHAYLFEVPDGTSKIEDSISTQNSVGPGVISSSRLRNLRFVRVPLDSYTREETPSESSCQRITIFKNINGYQGFFLSGSRPAWFMVFRERIRVHPQLCDGSIVAFTVLHNVNCNHGFIYVTSQGNLKICQLPSVSSYDNYWPVQKVPLKGTPHQVTYFAEKNLYPLIVSVPVHKPVNQVLSSLVDQEVSHQIENHNLSSDELHRTYSVEEFEVRILEPERSGGPWQTKATIPMQSSESALTVRVVTLFNTTTKENETLLAIGTAYVQGEDVAARGRVLLFSVGKNPDNSQVLVSEVYSKELKGAISALASLQGHLLIASGPKIILHKWTGTELNGVAFFDAPPLYVVSLNIVKNFILLGDVHKSIYFLSWKEQGAQLSLLAKDFGSLDCFATEFLIDGSTLSLVVSDEQKNAQIFYYAPKMSESWKGQKLLSRAEFHVGAHVTKFIRLQMLSTSDRSGTAPGSDKTNRFALLFGTLDGSIGCIAPLDELTFRRLQSLQKKLVDAVPHVAGLNPRSFRQFRENGRVHRPGPESIVDCELLSHYEMLPLEEQLEIAQQVGTTRAQILSNLNDLSLGTSFS

SEQ ID NO: 5568 - protein, 1459 aa, Prunus persica
MSFAAYKMMHWPTGIENCASGFISHSRSDFVPRIPPIQTEDLESEWPTSRREIGPIPDLVVTAGNVLEVYVVRVQEEDGTRGPRASGEPKRGGLMDGVSGASLELVCHYRLHGNVVTMAVLSSGGGDGSRRRDSIILTFEDAKISVLEFDDSIHGLRTSSMHCFEGPEWLHLRRGRESFARGPLVKVDPQGRCGSILVYGLQMIILKASQGGSGLVGDDDSFGSGGAISSRIESSYIVNLRDMDMKHVKDFTFLHGYIEPVMVILHERELTWAGRVSWKHHTCMISALSISTTLKQHPLIWSAVNLPHDAYKLLAVPSPIGGVLVISANSIHYHSQSASCALALNSYAVSADNSQEMPRSSFTVELDTANATWLLNDVALLSTKTGELLLLTLVYDGRVVQRLDLSKSKASVLTSGITKVGNSLFFLGSRLGDSLLVQFTCGVGGSVLSSDMKDEVGDIEGDAPLAKRLRMSSSDALQDMVSGEELSLYGSAPNNAESAQKSFSFAVRDSLINVGPLKDFSYGLRINADANATGIAKQSNYELVCCSGHGKNGALCVLRQSIRPEMITEVELPGCKGIWTVYHKNARGHNADSSKIAASDDEFHAYLIISLEARTMVLETADLLSEVTESVDYFVQGRTIAAGNLFGRRRVVQVYERGARILDGSFMTQDLSFGTSNSEMGSGSESSTVLSVSIVDPYVLLRMSDGGIRLLVGDPSLCTVSTSIPAAFESSKKSISACTLYHDKGPEPWLRKTSTDAWLSTGIDEAIDGADGVSHDQGDVYCVVCYESGSLEIFDVPNFNCVFSVDKFVSGNAHLIDTLMRDPPKDPQKLINKSSEEVSGQGRKENIQNMKVVELAMQRWSGQHSRPFLFGILNDGMILCYHAYLFEGPETASKTEDSASAQNTTGVSNLSASRLRNLRFVRVPLDTYAKKDTSNETSCQRMTIFKNIAGYQGLFLSGSRPAWFMVFRERLRIHPQLCDGSVVAVTVLHNVNCNHGLIYVTSQGILKICQLPPITSYDNYWPVQKIPLKGTPHQVTYFAEKNLYPLIVSVPVHKPLNQVLSSLVDQEVGHQVENHNLSSDELHRTYSVDEFEIRIMEPDKSGGPWQTKATIPMQTSENALTVRVVTLFNTTTKENETLLAIGTAYVQGEDVAGRGRVLLFSAGKSADNTQTLVSEVYSKELKGAISALASLQGHLLIASGPKIILHKWNGTELNGVAFFDVPPLYVVSLNIVKNFILLGDVHKSIYFLSWKEQGAQLTLLAKDFGNLDCFATEFLIDGSTLSLVVADEQKNIQIFYYAPKMSESWKGQKLLSRAEFHVGTHVTKFLRLQMLSTSSDRTGTNPGSDKTNRYALLFGTLDGSIGCIAPLDELTFRRLQSLQKKLVDAVHHVAGLNPRAFRQFQSNGKAHRPGPDTIVDCELLSHYEMLPLEEQLEIANQIGTTRSQIFSNLNDLSIGTSFL

SEQ ID NO: 5569 - protein, 1461 aa, Ricinus communis
MSYAAYKMLHWPTGIESCASGYITHSRADFVPQIPPIQTDNLDSEWPPSKRGIGPMPNLIVTAGSVLEVYVVRVQEDGSRESRSSRETKRGGLMDGVSGASLELVCHYRLHGNVESMVVLPTEGGDSSRRRDSIILAFKDAKISVLEFDDSIHGLRTSSMHCFEGPEWLHLKRGRESFARGPLLKVDPQGRCGGILVYDMQMIILRAAQASSGLVGDDDALSSGGSISARVQSSYVINLRDMDMKHVKDFIFLHDYIEPVVVILHERELTWAGRVSWKHHTCMISALSISTTLKQPTLIWSVVNLPHDAYKLLAVPPPIGGVLVICANTIHYHSESATYALALNNYAVSIDSSQELPRASFSVELDAVKAAWLLNDVALLSAKNGELLLLSLVYDGRVVQRLDLSKSKASVLTSDITTIGNSLFFLGSRLGDSLLVQFTNGLGPSVVSSGLKEEVGEIEGDVPSAKRLKRSASDGLQDMVSGEELSLYGSTANNTESAQKSFSFAVRDSLINVGPLKDFSYGLRSNYDASATGIAKQSNYDLVCCSGHGKNGTLCILRQSIRPEMITEVDLPGCRGIWTVYHKNARGHNVDLSKMAAAADEYHAYLIISMEARTMVLETADLLSEVTESVDYFVQGRTIAAGNLFGRRRVIQVFERGARILDGSFMTQDLSIGSSNSESSPGSESATVSSVSIADPYVLIKMTDGSIRLLIGDSSTCMVSINTPSAFENSERSVSACTLYHDKGPEPWLRKASTDAWLSTGVSEAIDGAESADGGPHDQGDIYCIVCYESGALEIFDVPNFNRVFSVDKFVSGKTHLADAYVREPPKDSQEKTNRISEEVAGLGRKENAHNMKAVELAMQRWSGHHSRPFLFGVLTDGTILCYHAYLFEAPDATSKTEDSVSAQNPVGLGSISASRLRNLRFVRVPLDSYIKEETSTENSCQRITIFNNISGHQGFFLLGSRPAWFMVFRERLRVHPQLCDGSIVAFTVLHNVNCNHGLIYVTSQGNLKICQLPSFSNYDNYWPVQKIPLKGTPHQVTYFPEKNLYPLIVSVPVHKPVNQVLSSLVDQEVGHQIENHNLSSDELLQTYSVEEFEVRILESENGGGPWQTKATIPMQSSENALTVRVVTLFNATTKENETLLAIGTAYVQGEDVAARGRVLLFSVVKSTENSQVLVSEVYSKELKGAISALASLQGHLLIASGPKIILHKWTGTELNGVAFYDAPPLYVASMNIVKNFILLGDIHKSIYFLSWKEQGAQLSLLAKDFGSLDCFATEFLIDGSTLSLVVSDEQKNIQIFYYAPKMLESWKGQKLLSRAEFHVGAHITKFIRLSMLSTSSDRSGAAPGPDKTNRFALLFGTLDGSIGCIAPLDELTFRRLQSLQRKLVDAVPHVAGLNPRSFRQFRSDGKVHRPGPESIVDCELLSHFEMLPLEEQLEIAQQVGTTRAQILSNLNDLSLGTSFL

SEQ ID NO: 5570 - protein, 330 aa, Cucumis sativus
NTTTKENETLLAVGTAYVQGEDVAARGRVLLFSVGKDADNSQTLVSEVYSKELKGAISALASLQGHLLIASGPKIILHKWTGAELNGIAFYDVPPLYVVSLNIVKNFILLGDIHKSIYFLSWKEQGAQLSLLAKDFGSLDCYATEFLIDGSTLSLTVSDDQKNIQIFYYAPKSTESWKGQKLLSRAEFHVGAHVTKFLRLQMLSTSSDKACSTVSDKTNRFALLFGTLDGSIGCIAPLDELTFRRLQSLQKKLGDAVPHVGGLNPRSFRQFHSNGKVHRRGPDSIVDCELLCHYEMLPLEEQLDIAHQIGTTRSQILSNLNDLSLGTSFL

SEQ ID NO: 5571 - protein, 1450 aa, Populus trichocarpa
MSYAAYKMMHWPTTIDTCVSGFVTHSRSESAHLPQLHTDDLDSDWPSRRRHGGGIGPTPNLIVASGNVLELYVVRVQEEGARSSGELKRGGVMDGVAGASLELVCHYRLHGNVESMGVLSVEGGDDSRRRDSIILAFKDAKISVLEFDDSIHGLRTSSMHCFEGPDWRHLKRGRESFARGPLVKVDPQGRCGGVLVYDLQMIILKAAQAGSALVQDEDAFGSGAAISAHIASSYIINLRDLDMKHVKDFIFVHDYIEPVVVVLHERELTWAGRVVWKHHTCMISALSISTTLKQPTLIWSIGNLPHDAYKLLAVPSPIGGVLVIGVNTIHYHSESASCALALNSYAASVDSSQELPRATFSVELDAANATWLLKDVALLSTKTGELLLLTLVYDGRVVQRLDLSKSKASVLTSDITTLGNSFFFLGSRLGDSLLVQFTSGLGSSMLSPGLKEEVGDIEGDLPSAKRLKVSSSDALQDMVSGEELSLYSSAPNNAESSQKTFSFTVRDSLINVGPLKDFAYGLRINADANATGISKQSNYELVCCSGHGKNGALCVLQQSIRPEMITEVELPGCKGIWTVYHKNARSHSVDSLKMASDDEYHAYLIISMEARTMVLETADHLTEVTESVDYFVQGRTIAAGNLFGRRRVVQVFERGARILDGSFMTQDLSFGGSNSETGRSESSTVMHVSIVDPYVLVRMADGSIQILVGDPSACTVSVNTPSAFQSSTKSVSACTLYHDKGPEPWLRKTSTDAWLSTGISEAIDGADSGAHEQGDIYCVVCYETGALEIFDVPNFNSVFFVDKFVSGKTHLLDTCTGEPAKDMMKGVKEEVAGAGRKESTQNMKVVELTMLRWSGRHSRPFLFGILTDGTILCYHAYLFEGPDGTSKLEDSVSAQNSVGASTISASRLRNLRFVRVPLDTYTREETSSETSCQRITTFKNISGYQGFFLSGSRPAWFMVFRERLRVHPQLCDGSIVAFTVLHTVNCNHGLIYVTSQGNLKICHLSSVSSYDNYWPVQKIPLKGTPHQVTYFAERNLYPLIVSVPVQKPVNQVLSSLVDQEVGHQIENHNLSSEEIHRTYSVDEFEVRILEPSNGPWQVKATIPMQTSENALTVRMVSLFNTSTKENETLLAVGTAYVQGEDVAARGRILLFSVVKNPENSQILVSEVYSKELKGAISALASLQGHLLIASGPKIILHKWTGTELTGVAFSDAPPLYVVSLNIVKNFILLGDIHKSIYFLSWKEQGAQLSLLAKDFASLDCFSTEFLIDGSTLSLVVSDEQKNVQIFYYAPKMSESWKGQKLLSRAEFHVGALVTKFMRLQMLSPSLDRSGAAPVSDKTNRFALLFGTLDGSIGCIAPLDELTFRRLQSLQKKLVDAVPHVAGLNPKSFRQFRSDGKAHRPGPESIVDCEMLSYYEMIPLEEQVEIAQQIGTTRAQILSNLNDLTLGTSFL

SEQ ID NO: 5572 - protein, 1455 aa, Populus trichocarpa
MSYAAYKMMHWPTTIDTCVSGFVTHSRSESAHLPQLHTDDLDSDWPSRRRHGGGIGPTPNLIVASGNVLELYVVRVQEEGARSSGELKRGGVMDGVAGASLELVCHYRLHGNVESMGVLSVEGGDDSRRRDSIILAFKDAKISVLEFDDSIHGLRTSSMHCFEGPDWRHLKRGRESFARGPLVKVDPQGRCGGVLVYDLQMIILKAAQAGSALVQDEDAFGSGAAISAHIASSYIINLRDLDMKHVKDFIFVHDYIEPVVVVLHERELTWAGRVVWKHHTCMISALSISTTLKQPTLIWSIGNLPHDAYKLLAVPSPIGGVLVIGVNTIHYHSESASCALALNSYAASVDSSQELPRATFSVELDAANATWLLKDVALLSTKTGELLLLTLVYDGRVVQRLDLSKSKASVLTSDITTLGNSFFFLGSRLGDSLLVQFTSGLGSSMLSPGLKEEVGDIEGDLPSAKRLKVSSSDALQDMVSGEELSLYSSAPNNAESSQVVSVIKTFSFTVRDSLINVGPLKDFAYGLRINADANATGISKQSNYELVCCSGHGKNGALCVLQQSIRPEMITEVELPGCKGIWTVYHKNARIHSVDSLKMASDDEYHAYLIISMEARTMVLETADHLTEVTESVDYFVQGRTIAAGNLFGRRRVVQVFERGARILDGSFMTQDLSFGGSNSETGRSESSTVMHVSIVDPYVLVRMADGSIQILVGDPSACTVSVNTPSAFQSSTKSVSACTLYHDKGPEPWLRKTSTDAWLSTGISEAIDGADSGAHEQGDIYCVVCYETGALEIFDVPNFNSVFFVDKFVSGKTHLLDTCTGEPAKDMMKGVKEEVAGAGRKESTQNMKVVELTMLRWSGRHSRPFLFGILTDGTILCYHAYLFEGPDGTSKLEDSVSAQNSVGASTISASRLRNLRFVRVPLDTYTREETSSETSCQRITTFKNISGYQGFFLSGSRPAWFMVFRERLRVHPQLCDGSIVAFTVLHTVNCNHGLIYVTSQGNLKICHLSSVSSYDNYWPVQKIPLKGTPHQVTYFAERNLYPLIVSVPVQKPVNQVLSSLVDQEVGHQIENHNLSSEEIHRTYSVDEFEVRILEPSNGPWQVKATIPMQTSENALTVRMVSLFNTSTKENETLLAVGTAYVQGEDVAARGRILLFSVVKNPENSQILVSEVYSKELKGAISALASLQGHLLIASGPKIILHKWTGTELTGVAFSDAPPLYVVSLNIVKNFILLGDIHKSIYFLSWKEQGAQLSLLAKDFASLDCFSTEFLIDGSTLSLVVSDEQKNVQIFYYAPKMSESWKGQKLLSRAEFHVGALVTKFMRLQMLSPSLDRSGAAPVSDKTNRFALLFGTLDGSIGCIAPLDELTFRRLQSLQKKLVDAVPHVAGLNPKSFRQFRSDGKAHRPGPESIVDCEMLSYYEMIPLEEQVEIAQQIGTTRAQILSNLNDLTLGTSFL

SEQ ID NO: 5573 - protein, 321 aa, Tropaeolum majus
STTKENETLLAIGTAYLQGEDVAARGRVLLFSLGRNDNPQNMVSEVYSKELKGAISALASIQGHLLLASGPKNILHKWNGTELNGVAFFDVPPLYVVSLNIVKNFILLGDIHKSIYFLSWKEQGAQISLLAKDFGSLDCLATEFLIDGSTLSLTVSDQQKNIQIFYYAPKMSESWKGQKLLSRAEFHVGAHVSKFLRLQMLASSASDKTNRFALLFGTLDGSLGCIAPLDELTFRRLQSLQKKLVDAVPHVCGLNPRSFRQFHSNGKAHRPGPDSVVDCELLCHYEMLPLEDQLEIANQIGTTRSQILANLNDLSIGTSFL

SEQ ID NO: 5574 - protein, 437 aa, Aquilegia formosa
VQKIPLKATPHQITYYAEKSLYPLIVSVPVVKPLNQVLSCLVDQDAGHQMEHDNISSDELHRTYTMDEFEVRILEPEKSGGPWQTRAKIPMQNSENALTVRMVTLFNTTTKENETLLAIGTAYVQGEDVAARGRVLLFSIGRNADNTQDLVSEVYSKELKGAISALASLQGHLFIASGPKVILHKWTGSDLNGVAFYDTPPLHVVSLNIVKNFILVGDIHKSIYFLSWKEQGSQLTLLAKDFGNLDCLSTEFLIDGSTLSLVVSDEQKNVQIFYYAPRTSESWKGQKLLSRAEFHVGAHVTKFLRLQMRPASSDRASSVPGSDKTNRFALLFGTLDGGVGCIAPLDELTFRRLQTLQKKLVDAVPHVGGLNPRSFRQFHSNGKAHRPGPDNMIDCELLCHYEMLQLEDQYEIANQIGTTRGQILTNLNDLSLGTSFL

SEQ ID NO: 5575 - protein, 330 aa, Euphorbia esula
  misc_feature (4)..(5): Xaa can be any naturally occurring amino acid
  misc_feature (211)..(211): Xaa can be any naturally occurring amino acid
NTTXXENDTLLAVGTAYVQGEDVAARGRVLLYSVVKNTESSQVQVSEVYCKELKGAISALASLQGHLLIASGPKIILHKWTGTELNGVAFYDAPPLYVASLNIVKNFILLGDVHKSIYFLSWKEQGAQLSLLAKDFGSLDCSATEFLIDGSTLSLVVSDEQKNVQIFYYAPKMSESWKGQKLLSRGEFHVGAHVTKFIRLAMLSTSDRSGXAPGSDKTNRFALLFGTLDGSVGCIAPLDELTFRRLQSLQKKLVDGVPHVGGLNPRSFRQFQSGGKVHRPGPESIVDCELLSDYEMLPLEEQLEIAQQIGTTRAQILSNLNDLSLGTSFL

SEQ ID NO: 5576 - protein, 477 aa, Artemisia annua
DGPIIAFTILHNMYCNHGFIYVTAQGSLKICQLPSSLSYDNYWPVQKIPLKATPHQVTYFAEKNLYPLIVSVPVSKPLNQVLSTSVDQESAHQIEHDNLNGDGVYTVEEFEVRIMEPESSGGPWKTKGTIRMQTSENALTVRVVTLSNTTTRESETLLAVGTAYVQGEDVAARGRVLLFSVENGTESSQATVTEVYSKEMKGAISAVAALQGYLLVASGPKIILHKWTGSDLSGVAFFDAPPLYVVSLNIVKNFILIGDIHKSIYFLSWKENGSQPTLLAKDFGSLNCFSTEFLIDGSTLSLMVSDDQKNVQIFYYAPKASESWKGQKLLSRAEFHVGAHATKFLRLQMLPTSDRTSAQPGSDKTNRFALLLGTLDGSIGCIAPLDELTFRRLQSLQKKLIDAVPHVAGLNPKSFRQFHSNGKAHRPGPDSIVDCELLCHYDMLPFEHQHEIANQIGTTRSQIISNLNDLALGTSFL

SEQ ID NO: 5577 - protein, 382 aa, Cajanus cajan
MNSDEQNRIYPIDEFEVRIMEPEKSGGPWQTKATIPMQSSENALTVRMVTLLNTTSKENETLLAVGTAYVQGEDVAARGRILLFSLGKNTDNPQTLVSEVYSKELKGAISALASLQGHLLIASGPKIILHKWSGTELNGIAFFDAPPLHVVSLNIVKNFILIGDIHKSIYFLSWKEQGAQLSLLAKDFGSLDCFATEFLIDGSTLSLMVSDDNRNIQIFYYAPKMSESWKGQKLLSRAEFHVGAHVTKFLRLQMLSTSDRAGSAPGSDKTNRFALLFGTLDGSIGCIAPLDELTFRRLQSLQRKLVDAVPHVAGLNPRAFRQFRSNGKAHRPGPDSIVDCELLCHYEMLPLEEQLEIANQIGTTRSQILSNLSDLSLGTSFL

SEQ ID NO: 5578 - protein, 1437 aa, Mimulus guttatus
MSFAAYKMMHWATGIEHCASGFITHSAADCTPGIAPVAADDMDSDWPASTKPVGPVPNLVTVAANVLEVYTVRVQEDSSSSMDSKGAAEPKRGGVLAGVSGASLELVCHYRLHGNVESLGVLPNGGGRRRDSIILTFRDAKISVLEFEDSIHGLRTSSMHCFEGPDWLHLKRGRECFPRGPLVKVDPLGRCAAVLIYGLQMIVLKAAEASSGLVGEENTSTSGPIGASRIESSYIIGLRDLDMKHVKDIIFLHGYIEPVVVILHEQELTWAGRVSWKNNTCMISALSISTTLKQHPLIWSATNLPHDAYKLLAVPSPIGGVLVIGANTIHYHSQSSSCLLALNNFAVPVDVSQEMPRSGFTTELDAANATWLTNDVAVFSSKSGELLLLTLVYDGRIVQRLELSKSRASVLTSDITTIGNSLFFLGSRLGDSLLVQYNFGVGAPIMAPGVKEEGGDIESDAPLPKRLRRSSSDALQDLGVGEELSFYSTGPTNAQLSQKTFTFAVRDSLLNVGPLKDFSYGLRINADPNATGIAKQSNYELVSCSGHGKNGALSVLQQSIRPDTITQESLPGCKGIWTVYHKNLRNDSSKGALDEDEYHAYLIISLENRTMVLQTANNLEEVTENVDYYVQGSTIAAGNLFGRRRVIQIFASGARILDGAFMTQDLSFKSSNSDASSASEGTIVSSVSIADPYVLLRMSDGSIQLLVGDPSTCSVSVTIPPVFESSDKMVAACTLYHDKGPELWLRRTSTDAWLSTGIGESIDGADGTTHDQGDVYLVLCYENGNLEMFDVPNFSSVFSVDKFVSGKSHILDTFFHGPANDPVKLMNKDPEDVGRGRKETAHNIKVVELCMQRWDAEQSRPFLFGILSDGSILCYHAYIYEDSDNASKTDLGSISSSRLRNLRFVRVCLDSYAREETPSGTSSQRISVFKNVGGLQGLFLSGSSPAWFMMFRERLRIHPQVCDGPIVAFTVLHNVNCNHGFICITSEGALKICQLPALSYDNYWPVQKVALKGTPHQVTYFAEKNLYPLIVSVPVLKPLNQVLSSLIDQEAGNQFEPDNFSSEGTYPMEEFEIRIMEPEKSAGPWQTRATIPMQTSENALTLRVVTLFNSTTQRNETLLAIGTAYVQGEDVAARGRVLLYSVEKSSDSAQTKVTEVYSKELKGAISALASLQGHLLIASGPKIILHKWTGSELNGVAFYDVPPLYVVSLNIVKNFILLGDIHKSIYFLSWKEQGSQLNLLAKDFGSLDTLATEFLIDGSTLSLIVSDEQKNVQIFYYAPKMSESWKGQKLLPRAEFHVGAHITKFLRLQLLPTSADRTNPGSDKTNRFGLLFGTLDGSIGCIAPLDELTFRRLQSLQKKLVDSVSHFAGLNPRSFRHFHSNGKAHRPGPDSIVDCELLFNFEMLRLEEQIEIAQQIGTTRTQIMSSLNDLTLSTSFL

SEQ ID NO: 5579 - protein, 327 aa, Artemisia annua
TRESETLLAVGTAYVQGEDVAARGRVLLFSVENGTESSQATVTEVYSKEMKGAISAVAALQGYLLVASGPKIILHKWTGSDLSGVAFFDAPPLFVVSLNIVKNFILIGDIHKSIYFLSWKENGSQLTLLAKDFGSLNCFSTEFLIDGSTLSLMVSDDQKNVQIFYYAPKASESWKGQKLLSRAEFHVGAHATKFLRLQMLPTSDRTSAQPGSDKTNRFALLLGTLDGSIGCIAPLDELTFRRLQSLQKKLIDAVPHVAGLNPKSFRQFHSNGKAHRPGPDSIVDCELLCHYDMLPFEHQHEIANQIGTTRSQIISNLNDLALGTSFL

SEQ ID NO: 5580 - protein, 328 aa, Lactuca sativa
IIHTTTRENVTLLAIGTAYVQGEDVAARGRVLLFSVENGTDVSQPAVTEVYSKEMKGAISALASIQGYLLVASGPKVILHKWTGSELSGVAFFDAPPLYVVSLNIVKNFILLGDIHKSIYFLSWKEQGSQLSLLAKDFGSLDCLATEFLIDGSTLSLMVSDDQKNVQIFYYAPKVSESWKGQKLLSRAEFHVGAHVTKFLRLQMLPTSNSSPSDKTNRFALVFGTLDGSIGCIAPLDELTFRRLQSLQKKLVDAVPHVAGLNPRSFRHFHSNGKAHRPGPDSIVDAELLCHYDMLPFEHQLEIANQIGTTRSQIISNLNDLALGTSFL

SEQ ID NO: 5581 - protein, 1444 aa, Arabidopsis lyrata
MSFAAFKMMHWPTGVENCASGYITHSLSDSTLQIPIVSGDDDMEAEWPNHKRGIGPLPNVVITAGNILEVYIVRAQEEGNTQELRIPKLVKRGGVMDGVSGVSLELVCHYRLHGNVESIAVLPMGGGNSSKGRDSIILTFRDAKISVLEFDDSIHSLRMTSMHCFEGPDWLHLKRGRESFPRGPLVKVDPQGRCGGVLVYGLQMIILKASQVGSGLVGDDDAFSSGGTVSARVESSYIINLRDLEMKHVKDFVFLHGYIEPVIVILQEEEHTWAGRVSWKHHTCVLSALSINTTLKQHPVIWSAINLPHDAYKLLAVPSPIGGVLVLCANTIHYHSQSASCALALNNYASSADSSQELPASNFSVELDAAHGTWISSDVALLSTKSGELLLLTLIYDGRAVQRLDLSKSKASVLASDITSVGNSLFFLGSRLGDSLLVQFSCRSGPAASLPGLRDEDEDIEGEGHQAKRLRISSDTFQDTIGNEELSLFGSTPNNSDSAQKSFSFAVRDSLVNVGPVKDFAYGLRINADANATGVSKQSNYELVCCSGHGKNGALCVLRQSVRPEMITEVELPGCKGIWTVYHKSSRGHNADSSKMAADEDEYHAYLIISVEARTMVLETADLLTEVTESVDYYVQGRTIAAGNLFGRRRVIQVFEHGARILDGSFMNQELSFGAPNSESNSGSESSTVSSVSIADPYVLLRMTDDSIRLLVGDPSTCTVSISSPSVLEGSKKKISACTLFHDKGPEPWLRKASTDAWLSSGVGEAVDSADGGPQDQGDIYCVLCYESGALEIFDVPGFNCVFSVDKFASGRRHLSDMPIHELEYELNKNSEDNASSRNEEIKNTKVVELSMQRWSGPHTRPFLFAVLADGTILCYHAYLFEGVDSTKAENSVSSENPAALNSSGSSKLRNLKFLRIPFDTSTREGTSDGVASQRITMFKNISGHQGFFLSGSRPGWCMLFRERLRFHSQLCDGSIAAFTVLHNVNCNHGFIYVTSQGILKICQLPSASIYDNYWPVQKIPLKATPHQVTYYAEKNLYPLIVSYPVSKPINQVLSSLVDQEAGQQIDNHNLSSDDLQRTYTVEEFEIQILEPERSGGPWETKATIPMQSSEHALTVRVVTLLNASTGENETLLAVGTAYVQGEDVAARGRVLLFSFGKNGDNSQNVVTEVYSRELKGAISAVASIQGHLLISSGPKIILHKWNGTELNGVAFFDAPPLYVVSMNVVKTFILLGDVHKSIYFLSWKEQGSQLSLLAKDFGSLDCFATEFLIDGNTLSLAVSDEQKNIQVFYYAPKMAESWKGQKLLSRAEFHVGSHVTKFLRLQMVTSGADKTNRFALLFGTLDGSFGCIAPLDEVTFRRLQSLQKKLVDAVPHVAGLNPHSFRQFRTSGKARRSGPDSIIDCELLCHYEMLPLEEQLELAHQIGTTRSVILLNLVELSVGTSFL

SEQ ID NO: 5582 - protein, 963 aa, Solanum phureja
LHDFPWSQKTFSFAVRDSLINVGPLKDFSYGMRINADLNATGIAKQSNYELVCCSGHGKNGSLCVLQQSIRPETITQEALPGCKGIWTVYHKNTRIHLSESSRMADEEDEYHAYLIISLEARTMVLQTANNLEEVTENVDYYVQGTTLAAGNLFGRRRVIQVFAHGARILDGAFMTQELSFKASNVESGSSSDTSIVASVSIADPYVLLRMTNGSLQLLVGDPSSCSVSLTVPSVFESSKKSISACTLYHDKGPEPWLRKTSTDAWLSSGMGEAIDGADGVTQDQGDVYCVVCYENGTLEIFDVPNFTCVFSVDKFISGRTYLVDTFMQDSVNGLHAHSKNTEDVIRPGQKENSKDVKINVVELMMHRWIGKHSRPFLFGILADGTILSYHAYVFEGSENSSKVEGSVSSQNSISLSSTNASRLRNLRFVRVPVDNYAREEMPSGTQLQRMNVYKNIGGSQGIFLTGSRPSWFMVFRERLRIHPQLCDGPIVAFTVLHNVNCNHGLIYVTALGTLKICQLPSFLSYDNYWPVQKIPLKGTPHQVAYFAEKNVYSVIVSVPVLKPLNQVLSTIADQEVGQQFDPDNLNYEGSYPIEEFEVRIVEPEKSGGLWKTRASIPMQSSENALTVRMVTLLNTTTRENETLLAVGTAYVQGEDVAARGRVLLFSIDRTADNSRTLVSEVYSKELKGAIPALASLQGHLLIASGPKIILHKWTGSELNGVAFCDYPPLHAVSLNIVKNFILLGDIHKSISFVSWKEPQLSLLAKDFSPLDCLATEFLIDGSTLSLVVSDDQKNVQIFYYAPKVSESWKGQKLLSRAEFHVGSRITKFLRLQLLPTTSERTATTPGSDKTNRFATVFGTLEGSLGCIAPLDELTFRRLQSLQKKLVTAVTHVAGLNPRSFRQFRSNGKAHRPGPDNIVDCELLSHYEMLPLEEQLEIAQQIGTTRMQIMSNLNDMILGTSFL

SEQ ID NO: 5583 - protein, 1447 aa, Solanum lycopersicum
MSFAACKTMHCPTGIENCASGFITHSAADITPQIQTADVDSDWPATKPIGPVPNLVVSAGNVLDVYLIRVEQASSRDAAEVVKRGGLVAGISAASLELVCTYRLHGNIYSMGVITAGGADGGKRRDSIILSFEDAKMSVLEFDDATHGLRTSSMHFFEGPDWFHLKRGRESFDKGPIIKVDPQGRCAGVFAFEQQMIVLKAAEVNSSLAGEDSAFSAGGASARIESSYIITLRDLDVRHVKDFTFLHGYIEPVMVILHERELTWSGRVSWKHHTCMVSAFSISTTLKQHPLIWSATNLPHDAYKLLAVPSPIGGVLVIGANTIHYHSQSSSCSLALNNFVFFGDNSQEMPRSSINVELDAANATWLTSDVAMLSTKTGELLLLTIIYDGRIVQKLDLSKSRASVLTSGITTIGDSLFFLGSRLGDSLLVQFSSGLGGSNLPPGVQEEVGDIESDAPSAKRLRMSSSDALQDMINGEELSLYGTAPNNAQSAQKTFSFAVRDSLINVGPLKDFSYGMRINADLNATGIAKQSNYELVCCSGHGKNGSLSVLQQSIRPETITQEALPGCKGIWTVYHKNTRIHLSESSRMADEEDEYHAYLIISLEARTMVLQTANNLEEVTENVDYYVQGTTLAAGNLFGRRRVIQVFAHGARILDGAFMTQELSFKASNVESGSSSDTSIVASVSIADPYVLLRMTNGSLQLLVGDPSSCSVSLTVPSVFESSKKSISACTLYHDKGPEPWLRKTSTDAWLSSGMGEAIDGADGVIQDQGDVYCVVCYENGTLEIFDVPSFTCVFSVDKFISGRTYLVDTFMQDSVNGLHAHSKNTEDVIRPGQKENSKDVKINVVELMMHRWIGKHSRPFLFGILADGTILSYHAYVFEGSENSSKVDGSVSSQNSISLSSTNASRLRNLRFVRVPVDNYAREEMPSGSQLQRMNVYKNIGGSQGIFLTGSRPSWFMVFRERLRIHPQLCDGPIVAFTVLHNVNCNHGLIYVTALGTLKICQLPSFLSYDNYWPVQKIPLKGTPHQVAYFAEKNVYSVIVSVPVLKPLNQVLSSIADQEVGQQFDPDNLNYEGSYPIEEFEVRILEPEKSGGPWKTRASIPMQSSENALTVRMVTLFNTKTKENETLLAVGTAYVQGEDVAARGRVLLFSIDRTADNSRTLVSEVYSKELKGAIPALASLQGHLLIASGPKIILHKWTGSELNGVAFCDYPPLHAVSLNIVKNFILLGDIHKSISFVSWKEPQLSLLAKDFSPLDCLATEFLIDGSTLSLVVSDDQKNVQIFYYAPKVSESWKGQKLLSRAEFHVGSRITKFLRLQLLPTTSERTATTPGSDKTNRFATVFGTLEGSLGCIAPLDELTFRRLQSLQKKLVTAVTHVAGLNPRSFRQFRSNGKAHRPGPDNIVDCELLSHYEMLPLEEQLEIAQQIGTTRMQIMSNLNDMILGTSFL

SEQ ID NO: 5584 - protein, 660 aa, Solanum lycopersicum
  misc_feature (339)..(339): Xaa can be any naturally occurring amino acid
  misc_feature (384)..(384): Xaa can be any naturally occurring amino acid
VPSFTCVFSVDKFISGRTYLVDTFMQDSVNGLHAHSKNTEDVIRPGQKENSKDVKINVVELMMHRWIGKHSRPFLFGILADGTILSYHAYVFEGSENSSKVDGSVSSQNSISLSSTNASRLRNLRFVRVPVDNYAREEMPSGSQLQRMNVYKNIGGSQGIFLTGSRPSWFMVFRERLRIHPQLCDGPIVAFTVLHNVNCNHGLIYVTALGTLKICQLPSFLSYDNYWPVQKIPLKGTPHQVAYFAEKNVYSVIVSVPVLKPLNQVLSSIADQEVGQQFDPDNLNYEGSYPIEEFEVRILEPEKSGGPWKTRASIPMQSSENALTVRMVTLFNTKTKENXTLLAVGTAYVQGEDVAARGRVLLFSIDRTADNSRTLVSEVYSKEXKGAIPALASLQGHLLIASGPKIILHKWTGSELNGVAFCDYPPLHAVSLNIVKNFILLGDIHKSISFVSWKEPQLSLLAKDFSPLDCLATEFLIDGSTLSLVVSDDQKNVQIFYYAPKVSESWKGQKLLSRAEFHVGSRITKFLRLQLLPTTSERTATTPGSDKTNRFATVFGTLEGSLGCIAPLDELTFRRLQSLQKKLVTAVTHVAGLNPRSFRQFRSNGKAHRPGPDNIVDCELLSHYEMLPLEEQLEIAQQIGTTRMQIMSNLNDMILGTSFL

SEQ ID NO: 5585 - protein, 475 aa, Zea mays
QLCDGPIVAFTVLHNVNCCRGLIYVTSQGFLKICQLPSAYNYDNYWPVQKVPLHGTPHQVTYYGEQSLYPLIVSVPVRPLNQVLSSMADQELGLHMENDVTSGGDLQEVYTVDEFEVRIMELGKSNGRWETRSTIPMQSFENALTVRIVTLQNTSTKENETLMAIGTAYVQGEDVAARGRVLLFSFSKSENSQNLVTEVYSKESKGAVSAVAALQGHLLIASGPKITLNKWTGSELTAVAFYDAPLHVVSLNIVKNFVLFGDIHKSIYFLSWKEQGSQLSLLAKDFGSLDCFATEFLIDGSTLSLVVSDSDKNVQIFYYAPKMVESWKGQKLLSRAEFHVGAHVSKFLRLQMLPTQGLASEKTNRFALVFGTLDGGIGCIAPVDELTFRRLQSLQRKLVDAIPHVCGLNPRSFRHFKSNGKAHRPGPDNIIDFELLSHYEMMSLEEQLEIAQQIGTTRSQILSNFSDFSLGTSFL

SEQ ID NO: 5586 - protein, 733 aa, Zea mays
DPSTCTISINAPAIFASSSERISACTLYCDRGPEPWLRKTHTDAWLSTDVGEAIDDNDNSSHDLSDIYCIICYESGKLEIFEVPSFKRVFSVDNFVSGPAILFDVFSRNSTKDSGIGDRDASKVSVKKEEAANIKIVELAMHRWSGQFSRPFLFGLLNDGTLLCYHAYYFEGSESNVQCAPFSPHGGSPDIGNATDSRLRNLRFCRVSIDISSRDDISCLVRPRITIFNNVGGYEGLFLGGPRPTWVFVCRQRFRVHPQLCDGPIVAFTVLHNVNCCRGLIYVTSQGFLKICQLPSAYNYDNYWPVQKVPLHGTPHQVTYYGEQSLYPLIVSVPVRPLNQVLSSMADQELGLHMENDVTSGGDLQEVYTVDEFEVRIMELGKSNGRWETRSTIPMQSFENALTVRIVTLQNTSTKENETLMAIGTAYVQGEDVAARGRVLLFSFSKSENSQNLVTEVYSKESKGAVSAVAALQGHLLIASGPKITLNKWTGSELTAVAFYDAPLHVVSLNIVKNFVLFGDIHKSIYFLSWKEQGSQLSLLAKDFGSLDCFATEFLIDGSTLSLVVSDSDKNVQIFYYAPKMVESWKGQKLLSRAEFHVGAHVSKFLRLQMLPTQGLASEKTNRFALVFGTLDGGIGCIAPVDELTFRRLQSLQRKLVDAIPHVCGLNPRSFRHFKSNGKAHRPGPDNIIDFELLSHYEMMSLEEQLEIAQQIGTTRSQILSNFSDFSLGTSFL

SEQ ID NO: 5587 - protein, 1439 aa, Sorghum bicolor
MSYAAYKMMHWPTSIDHCAAGFITHSPADAAAFSSAAPAAAASGPDGDIDSAAASAPRRVGPTPNLVVSAANVLEVYAVRADSATGAEDVGNSSSTGAILDGISGARLELVCHYRLHGNIESMAVLSDGTENRRDSIAVTFKDAKIACMEFDDSTNGLRTSSMHCFEGPEWFHLKRGRESFAWGPIIKADPQGRCGAVLVYGLQMIILKAAEVGQSLVGEDEPTRMLSSTAVRIESSYVIDLRDLEMNHIKDFTFVHGYIEPVLVILHEREPTWAGRISSKSQTCMLSAFSISMGLKQHPMIWSAAKLPHDAYQLLAVPPPISGILVICANSIHYHSQSTSCSLALNSFSSQPDGSPEILKTSFHVELDVAKATWLSHDIVMFSSKNGEILLLTVVYDGRAVQRLDLMKSKASVLSSGATTLGSSFFFLGSRLADSLLVQFSCGVPTSVLPDLTDESADIEGDLPFSKRLKRIPSDVLQDVTSVEELSFHNKTVPNIVDSAQKISFVVRDALINVGPLKDFAYGLRTNSDPNATGIAKQSNYELVCCSGHGKNGTLSALQQSIRPDLITEVELPSCTGIWTVYYKSSRGNTADNNEYHAYLIISLESRTMVLQTGDDLGEVTETVDYNVQASTIAAGNLFGRRRVIQVYAKGARVLDGSFMTQELNFSMHTSESSLSSEPLAAASASIADPYVLLKMGDGSIRLLIGDHSTCTISINAPAICASSSERISSCTLYCDRGPEPWLRKTRTDAWISTGIGEVTDVNDNSSHDLSDIYCIICYESGKLEIFEVPSFKCVFSVDNFVSGPSILFDAFSHISTKGSGIGDRDATKVSVKKEEATSIKIVELAMHRWSGQFSRPFLFGLLNDGTLLCYHAYYYESSESNVQCAPSSPHGLPDIGNATDSRLRNLRFRRVSIDISSRDDISCLVRPRITIFNNVGGYEGLFLGGPRPTWIFVCRQRFRVHPQLCDGPIVAFTVLHNVNCCRGLIYVTSQGFLKICQLPSAYNYDNYWPVQKVPLHGTPHQVTYYAEQSLYPLIVSVPVRPLNQVLSSMADQELGLHIENDVTSGDDLQKVYTVDEFEVRIMELGKPSGHWETRFTIPMQSFENALTVRIVTLQNTSTKENETLMAIGTAYVQGEDVAARGRVLLYSFSRSENSQNLVTEVYSKESKGAVSAVASLQGHLLIASGPKITLNKWTGSELTAVAFYDAPLHVVSLNIVKNFVLFGDIHKSIYFLSWKEQGSQLNLLAKDFGSLDCFATEFLIDGSTLSLVVSDSDKNVQIFYYAPKMVESWKGQKLLSRAEFHVGAHVSKFLRLQMLPTQGLASEKTNRFALVFGTLDGGIGCIAPVDELTFRRLQSLQRKLVDAVPHVCGLNPRSFRHFKSNGKAHRPGPDNIIDFELLSHYEMLSLEEQLEIAQQIGTTRSQILSNFSDFLLGTSFL

SEQ ID NO: 5588 - protein, 353 aa, Panicum virgatum
EKPSGRWETRFTIPMQPFENALTVRIVTLQNTTTKENETLMAIGTAYVQGEDVAARGRVLLFSFSKTENSQNLVTEVYSKESKGAVSAVASLQGHLLIASGPKITLNKWTGSELTAVAFYDAPLHVVSLNIVKNFILFGDIHKSIYFLSWKEQGSQLSLLAKDFGSLESFATEFLIDGSTLSLVVSDSDKNLQIFYYAPKMVESWKGQKLLSRAEFHVGAHVSKLLRIQMLPTQGLVSEKTNRFALVFGTLDGGIGCIAPVDELTFRRLQSLQRKLVDAVPHVCGLNPRSFRHFKSNGKAHRPGPDNIIDFELLSHYEMLSLGEQLDIAQQIGTTRSQILSNFSDFLLSTSFL

SEQ ID NO: 5589 - protein, 466 aa, Glycine max
MKKIRNSILLLSIFLAASSAVSSAEPIPSAAYDRVLFPDRRCQKTVSENKTRRGSSAAAAAGCEVWSESCSEAVLSVARRAETAEWLKNIRRKIHANPELAFEEIETSRLIREELDLMEVSYRYPLAKTGIRAWIGTGGPPFVAIRADMDALPIQEAVEWEYKSKVAGKMHACGHDAHVAMLIGAAKILKTREHLLKGTVILLFQPAEEAGNGAKRMMQDGALEDVEAIFAAHVSHEHPTGIIGSRRGPLLAGCGFFRAVISGKKGLAADPHRSVDPVLAASAAVISLQGIVSREANPLDSQVVSVTSFNGGNKLDMIPDTVVLLGTFRAFSNTSFYQLLERIEQVIVEQTSVYRCLAEVDFFEKEYTIYPPTVNDDRMYEHVKKVSIDLLGHKNFRVVPPMMGAEDFSFYSEMVPSAFFYIGVRNETLGSTHTGHSPYFMIDEDVLPIGAAAHASIAERYLIEHG

SEQ ID NO: 5590 - protein, 467 aa, Lotus japonicus
MEIRCFSMAMVFLVLLINLRETAAVPSAVYDGGVLFPDRRCREDRETVSPGNLTRRRTEAVGGCEVWSEACSEAVMKVARRPEMAEWLKRLRRRIHSNPELAFEEIETSGLIRKELDLMGVSYRYPLARTGIRAWIGTGGPPFVAIRADMDALPIQEAVEWEYKSKVAGKMHACGHDAHVAMLIGAAKILKTREHLLKGTVILIFQPAEEAGNGAKRMMQDGALEDVEAIFAVHVSHEHPTGIIGSRPGPLLAGCGFFRAVISGKTAIAGNPQRSVDPVLAASAAVISLQGIVSRESNPLDSQVISVTSFDGGNNLDMIPDRVVIGGTFRAFSNTSFYQILERIEQVIVEQARVYRCSAEVDFFEKEYTIYPPTVNDDRMYEHVKKVSIDLLGQENFRVVPPMMGAEDFSFYSEAVPSAFYYIGIRNETLGSTHTGHSPYFMIDEDALPTGAAVHATIAERYLIEHS

SEQ ID NO: 5591 - protein, 476 aa, Medicago truncatula
MKFRNSLFYFMIIFSSTVIILEHFAVSTAVKIPSAAYDRVLFSDRRCCDRENNELTLSPCKNVTRKAKTATNCEVWNEACSEAVLSVARLPETVEWLKSVRRKIHENPELAFEEIETSRLIRKELDLMEVSYRYPLAKTGIRAWIGTGGPPFVAVRADMDALPIQEGVEWEYKSKVAGKMHACGHDAHVAMLIGAAKILKTREHLLKGTVILLFQPAEEAGNGAKRMIQDGALEDVEAIFAVHVSHEHPTGMIGSRPGPLLAGCGFFRAVISGKRASAANPRNSADPVLAASAAVISIQGIVSRESNPLDSQVVSVTSFNGGNSHDMIPDSVVIGGTFRAFSNTSFYQLLERIEQVIVQQASVYSCFAEVDFFEKEYTIYPPTVNDDQMYEHVKKVSIDLLGQKNFRVVPPMMGAEDYSFYSQVIPSAFFYIGIRNETLGSTHTGHSPHFTIDEDALPIGAAVHATIAERYLNEHG

SEQ ID NO: 5592 - protein, 405 aa, Glycine max
MAASLQLFQCKLARPFRSFPLRRSTPPLSLRCCASPPSSYSITLIPGDGIGPEIISVAKDVLVLVGSLEGIKFEFQEVLMGGAALDATGVPLPDDTLSAAKQSHAVLLGAVGGYKWDKNEKHLKPETGLLQIRKELGVFANLRPATVYSPLVDASTLKREVAEGVDIMLIRELTGGIYFGEPRGFGTNENGEEIGFNTEIYATHEIDRIAHFAFKVAQKRCGKLCSVDKANVLEASMLWRKRFLAIAQEYPDVELSHMYVDNASMQLIRNPKQFDTMVTNNIFGDILSDEASMVTGSIGMLPSASLGASGPGLFEPIHGSAPDIAGQDKANPFATVLSAAMLLRYGLGEEKAAKRIENAVVDTLNRGFRTGDIYSAGTKLVGCKQLGEEILKSVESNVHAGAATV

SEQ ID NO: 5593 - protein, 409 aa, Glycine max
MAACLQLWQCKLARPFDSLPVRRSIPLSLRCSAAPSSSKPTRSYSITLIPGDGIGPEIISVAKDVLVLAGYLEGIKYDFREMLMGGAALDATGLPLPHETLSAAKQSHAVLLGAVGGYKWDRNDKHLKPETGLLQIRKELGVFANLRPATVYSPLVDASTLKREVAEGVDIMLIRELTGGIYFGEPRGFGTNDNGEEIGFNTEIYATHEIDRIAHFAFKVAQKRRRKLCSVDKANVLEASMLWRKRFLAIAQEYPDVELSHMYVDNASMQLIRDPKQFDTMVTNNIFGDILSDEASMVTGSIGMLPSASLGASGPGLFEPIHGSAPDIAGQDKANPFATVLSAAMLLRYGLGEEKAAERIENAVMDTLNRGFRTGDIYSAGTKLVGCKQLGEEILKSVESNVPAGAAAV

SEQ ID NO: 5594 - protein, 405 aa, Cajanus cajan
MAASLQLLHCKLARPFHSFSCPRSTPLRCSAAPPPSKSPRRYTITLLPGDGIGPEVISVAKDVLLLAGSLEGIKYDFREMLLGGAALDATGVPLPEETLSVAKQSDAVLLGAIGGYKWDINEKHLKPETGLLQIRQGLRVFANLRPATVFPQLVDASTLKREIAEGVDLMVVRELTGGIYFGKPRGFGTNENGEEIGYNTEIYAAHEIDRIAHVAFKIAQKRSGKLCSVDKANVLEASMFWRKRVLAIAQEYPDVELSHMYVDNASMQLIRNPKQFDTIVTNNIFGDILSDEASMITGSIGMLPSASLGDSGPGLFEPIHGSAPDIAGQDKANPFATVLSAAMLLRYGLGEDKAAGRIENAVLDTLNRGFRTADIYSAGTKLVGCKQLGEEILKSVESNVPAAAV

SEQ ID NO: 5595 - protein, 406 aa, Vigna unguiculata
MAASLQLLQFKPVKPSFSFFSRRSAPIICSAAPTPSKSQRSYTITLLPGDGIGPEVISVAKDVLILAGSLEGIKYEFRERLIGGAALDATGVPLPDETLSSAKQSDAVLLGAVGGYKWDNNDKHLKPETALLGLRQELKVFANLRPASVFPQLVDASTLKREVAEGVDLMVVRELTGGIYFGKPRGFGTNEDGEECGFNTEIYAQHEIDRIAHAAFKIARKRNGKLCSVDKANVLEASILWRRRVSAIAQEYPDVELSHMYVDNAAMQLIRNPKQFDTIVTNNIFGDILSDEASMITGSIGMLPSASLGASGPGLFEPIHGSAPDIAGQDKANPFATVLSAAMLLKYGLDEGKAAQRIENAVLDTLNKGLRTGDIYSPGTKLVGCKELGEEIMKSVESNVPSGATV

SEQ ID NO: 5596 - protein, 405 aa, Medicago truncatula
MSTSLQTELFHLKPFHFRTPSSSKRTSLRCSATVPSSKRSYKITLLPGDGIGPEVISVAKDILLLTGSLHGIKLEFQEKLLGGAALDATGVPLPDDTLSAAKQSDAVLLGAIGGYKWDKNEKHLKPETGLLQLREGLQVFANLRPATVFPQLVDASTLKREVAEGVDLMVVRELTGGIYFGKPRGFGTNENGEETGFNTEIYAAHEIDRIARVAFNIARKRGGKLCSVDKANVLEASMFWRKRVVALAQEYPDVELSHMYVDNAAMQLVRYPKQFDTIVTNNIFGDILSDEASMITGSIGMLPSASLGDSGPGLFEPIHGSAPDIAGQDKANPFATVLSAAMLLKYGLGEVEAAERIERAVLETLNRGFRTADIYSDGTKLVGCKQLGEEILKSVESHVPAAAAV

SEQ ID NO: 5597 - protein, 612 aa, Glycine max
MTIIDAFLFIIVHSVDKLGIWPRLPVFLGLLYLAFRRHLHQEYNLFNVGTTPVGVRFNHSDFPYRTADGKYNDPFNEVSGSHGTFFGRNILPVDQKKKLLKPDPMVVATKLLARRTYKDTGKQFNVIAASWIQFMIHDWIDHLEDTNQIELIAPREVASQCPLRSFKFYKTKEIPTGFFEIKSGSSNIRTPWWDASVVYGSNGEVLQRVRTFKDGKIKISKDGHLLHNENGTAIAGDIRNSWAGVSTLQSLFIQEHNAVCDTLKKHYPHLGDEELYRHARLVTSAVIAKVHTIDWTVELLRTDTLLAGMRANWYGLLGKPFKDTFGHVGGVILGGLVGLKRPENHGVTYSLTEEFATVYRMHSLLPDNLQLRDISATPGPNKSLPLIKEIPMKNLIGLQGEKTLSEIGLARQLVSMGHQACGALELWNYPEWLRDLVPQEIDGTDRPDHVDLAALEIYRDRERSVARYNQFRRALLLIPISKWEDLTDDKEAIQVLEEVYGDDVEELDVLVGLMAEKKIKGFAISETAFVIFLLMATRRLKADRFFTSNFNEETYTKKGLEWVNTTESLKDVIDRHYPEMTHKWLNSSSAFSVWDSPPNTHNHIPLYLRVPH

SEQ ID NO: 5598 - protein, 633 aa, Vigna unguiculata
ANVLHHFIHKDFHEAVAKMTIIDAFLFIIVHSIDKLGIWPRLPVFLGLLYLAIRRHLHQEYNLFNVGTTPTGVRFNPSDFPYRTADGKYNDPFNEVVGSEGTFFGRNMLPVDQKKKLLKPGPMVVATKLLARRTYKDTGKQFNVIAASWIQFMIHDWIDHLEDTKQIELTAPKEVSSQCPLKSFKFFKTKEIPTVPTGFYEIKSGSLNIRTPWWDASVVYGSNGEVLQKVRTFKDGKVKISKDGNLVHNENGTAVAGDVRNSWAGVSTLQSLFIQEHNAVCDSLKKYYPDLNDEELYRHARLVTSAVIAKIHTIDWTVELLKTDTLLAGMRINWYGLLGKKFKDTFGHVVGSILGGFVGMKKPENHGVKYSLTEEFVSVYRMHSLLPDNLQLRDISATPGPNKSPPVIKEIPMKNLIGLPGEKTLSEIGVAIQLVSMGHQACGALELWNYPQFLRDLVPQNVDGTERSEHVDLAALEIYRDRERNVPRYNQFRRALLLIPITKWEDLTDDKEAIEVLEEVYGDDVEELDLLVGLMAEKKIKGFAISETAFVIFLLMASRRLEADRFFTSNYNEETYTKKGLEWVNTTESLKDVIDRHYPEMTHKWLNSSSAFSVWDSLPNSPNHVPLYLRVPH

SEQ ID NO: 5599 - protein, 612 aa, Medicago truncatula
MSIIDAFLFLIVHSIDKLGIWHRLPVFLGLIYLAIRRHLHQEYNLINVGTTPVGVRSNPTDFPYRTADGRYNDPFNENAGSQGSFFGRNILPVDQKKKLLKPDPMVVATKLLERRTYKDTGKQFNVIAASWIQFMIHDWIDHMEDTQQIELIAPREVVNQCPLKSFKFFKTKEIPTGFYEVQTGHANIRTPWWDGSVIYGSNQEVLDKVRTFKDGKIKISKEGELLHNEDGTAISGDIRNSWAGVTTLQTLFVLEHNAVCDSLKKEYPDLEDEDLYRYARLVTSAVIAKIHTIDWTVELLKTDTLLGGMRANWYGLLGKKFKDTFGHSGNSILSGFVGMKRAENHGVPYSLTEEFASVYRMHPLLPDFLHLRDTSASPGPNKSPPLIKEIPMNDLIGLQGEKTLIEIGVQKQLVSMGHQACGALELWNYPSWLRNLVPHNMDGTERSDHVDLAALEIYRDRERGVARYNQFRRGLFMIPISKWEDLTDDKEVIKVLEEIYGDDVEELDVLVGLMAEKKIKGFAISETAFLIFLLMASRRLEGDRFFTSNYNEETYTEKGLKWVNTTETLKDVIDRHYPKMTNKWLNASSAFSVWDAPPNKHNPIPIYLRVPS

SEQ ID NO: 5600 - protein, 612 aa, Pisum sativum
MTIIDAFLFFIVHSIDKLGIWHRLPVFFGLLYLAIRRHLHQEYNLLNVGTTPVGIRSNPSDFPYRTADGRYNDPFNDGAGSQGSFFGRNILPVDQKNKLLKPDPMVVVTKLLERKTYKDTGTQFNVIAASWIQFMIHDWIDHMEDTKQVELSAPSEVASQCPLKSFKFFKTKEIPTGFYDIKTGHANVRTPWWDGSVVYGSNEQVLNKVRTFKDGKLKISKEGHLLHNEDGTAISGDIRNSWAGVTTLQTLFVQEHNAVCDALKKENSDLEDEDLYRHARLVTSAVIAKIHTIDWTVELLKTDTLLAGMRANWYGLLGKQFKDRFGHVGNSILSGFVGMKRSENHGVPYSLTEEFATVYRMHPLLPDSLHLRDISASPGPNKSPPLIKEIPMNDLIGLQGEKTLLEIGNAKKLVSMGHQACGALELWNYPSWLRNLVPHNIDGTERSDHVDLAALEVYRDRERNVARYNQFRRGLLLIPISKWEDLTDDEEAIKVLEEVYGDDVEELDVLVGLMAEKKIKGFAISETAFVIFLLMASRRLEADRFFTSNFNEETYTKKGLEWVNTTESLKDVIDRHHPEMTHKWLNSSSAFSVWDTSPNKHNHIPIYFRVPN

SEQ ID NO: 5601 - protein, 380 aa, Glycine max
MNELSQKQTLVVHGIAGAGSVALATAFTYPLDTMKVLIQVGSSTGKELDHTHVLTRLLSVSGNAGLFNGFGWLLVGRIFGLGARFGVYEILSAFYKDGRENNYLFASEALLAGVVAGAIEAVISSPFELIKLRMQVSSASYVPSSNFALEKGARTPLIARLLHGCYPDRRALDQYIGLISTLKAKNTNLTSALLEYPWTMTGSGSPPSVSNVRRPSDIISLEGWSTLWRGLRSGIVRDSVFGGVFFSTWQFLHQAMLDWKAAGMNPPPRLNEEVGPLSPLTVSLTAGFSASVAAAASHSFDTTRSRSQCTVLPKYISMERKILKWKRPGNKFERITGIHPSDRGVLFRGIGWRMARSGLASFIIVGSYLFVADQLASSLT

SEQ ID NO: 5602 - protein, 380 aa, Cajanus cajan
MEELSQNQTIVVHGIAGAAPVTLATAFTYPLDTIKVLIQVGSSASKELDAARALTRVVSLSGNAGLYDGFGWFAVGRIFGLGARFGVYEILTALYKDGREDNYLLASEALLAGMAAGAIEAVISSPFELIKLRMQVASASYVPSSKFSLEKGARTPLIARLLHGCYPDKRSLNLYVGLISSLTTKNTNVTSALLEYPWTMTGSGMPPSVSSVKRPSNIISLEGWSTLWRGLRSGIVRDSVFGGIFFSTWQFLHEAMLDWKAVGMNPPPRSNEDISPLSPLTVSLTAGFSASLAAAASHGFDTSRSRSLCTVLPKYISMERKLLKWKPQGNKFERYTGIHPSDRNVLFRGIGWRMARSGLASFLIVGSYFFVADHLASSLT

SEQ ID NO: 5603 - protein, 380 aa, Vigna unguiculata
MKELSQNQTIAVHGIAGAGSVAFATAFTYPLDTMKVLIQVGSSTGKQLDAAQALSRVVFLSGNAGLYSGFGWLAVGRIFGLGARFGVYEILTAFYKDGREDNYLFPSEALLAGMASGAIETVISSPFELIKLRKQVTSASYVPSPNFALENGARKPLIARLLNGCYPDKRSLDLYTRLISTLTTKNTNMTSALLEYPWTMSGSGKPPAVSSVTRPSDIISLEGWSTLWRGLRSGIARDSVFGGVFFSTWQLLHQAMVDWKAVGMNPPPRFNEDIGPLSPFTVSLTAGFSASVAAAASHGFDTSRSRSQCNVLPKYISMERKILKWKRPGNKFERITGIHPSDRSVLFHGIGWRIARAGLASSMIVGSYLFVADQLTSILT

SEQ ID NO: 5604 - protein, 592 aa, Glycine max
MSSFRALFFFFLINVSLLLTLSSAADPFVSYEFEVSYITASPLGVPQQVIAINNKFPGPIINVTTNNNVAVNVRNKLDESLLIHWSGIQQRRSSWQDGVLGTNCPIPAKWNWTYQFQVKDQIGSFFYFPSLHLQRAAGGFGGFIINNRAIIPIPFDTPHGDIVVFIGDWYTRNHTDLRKALDDGKDLGMPDGVLINGKGPYRYNNTLVPDGIDYETIEVHPGKTYRLRVHNVGVSTSLNFRIQSHNLLLAETEGSYTVQQNYTSLDIHVGQSYSFLLSTDQNASTDYYIVASARFVNESRWQRVTGVAILRYTNSKGKARGPLPPAPDDQFDKTYSMNQARSIRWNVSASGARPNPQGSFRYGSINVTDIYVLKNKPLEKINGKRRATLSGNSFVNPSTPIRLADQYKLKGVYKLDFPTKPLTGSPRTETSVINGTYRGFMEIILQNNDTKMHTYHMSGYAFFVVGMDFGDWSENSRGTYNKWDGIARTTAQVYPGAWTAILVSLDNVGVWNLRTENLDSWYLGQETYVRVVNPEVNNKTELPIPDNALFCGALSKLQKPQKVSSDAPSISRNKLKLFFTWLIVFAWIHIFQ

SEQ ID NO: 5605 - protein, 591 aa, Vigna unguiculata
MSSSTAFFFFLVNVSLLLTLSSAADPFVSYDFEVSYITASPLGVPQQVIAINKKFPGPTINVTTNNNVAVNVRNKLDESLLLHWSGIQQRRSSWQDGVLGTNCPIPSKWNWTYQFQVKDQIGSFFYFPSLHLQRAAGGFGGFIINNRPIIPIPFDTPYDDIVVFIGDWYTRNHTDLRKALDDGKDLGMPDGVLINGKGPYRYNDTLVPDGIDYETIEVHPGKTYRLRVHNVGVSTSLNFRIQSHNLLLAETEGSYTVQQNYTSLDIHVGQSYSFLVTMDQNASSDYYIVASARFVNESRWQKVTGVAILRYTNSKGKAHGPLPPAPDDQFDKTYSMNQARSIRWNVSASGARPNPQGSFRYGSINVTEIYVLKNKLPEKINGKRRATVSGISFVNPSTPIRLADQYKLKGVYKLDFPTKPITGPPRAETSIINGTYRGFMEVILQNNDTKMHTYHMSGYAFFVVGMDYGDWSENSRGTYNKWDGIARTTAQVYPGAWTAILVSLDNVGVWNLRTENLDSWYLGQETYVRVVNPEVTNKTELPIPDNALFCGALSKLQKPQVIASAASPINGNTLKLFFTWLIICAWIHIFQ

SEQ ID NO: 5606 - protein, 595 aa, Arachis hypogaea
MALFKALVLFFFFFFLTNVSLLLNFTNAEDPFAFYNFEVTYLTASPLGVPQQVIAINGKFPGPTINVTTNNNVVVNVRNKLDENLLLHWSGVQQRRSSWQDGVLGTNCPIPPKWNWTYQFQVKDQIGSFFYFPSLNMQRAAGGFGGFIINNRPIIPIPFDTPHGDIVIMIGDWYTRNHTDLRKDLDAGKDLGMPDGVLINGKGPYRYNDTLVPDGIDFEQFDVHPGKTYRLRVHNVGVSTSLNFRIQSHNLLLAESEGSYTVQQNYTSLDIHVGQSYSFLVTMDQNASSDYYIVASARFVNESRWQRVTGVGILRYTNSKGKAHGPLPPPPDDEFDKTFSMNQARSIRWNVSASGARPNPQGSFRYGSINVTEIYVLRNKPREKINGKNRATLSGISFVNPSTPIRLADKYKLKGVYKLDFPTNPITGPPQAKTSVINGTYRGFMEIILQNNDTKMHSYHLDGYAFFVVGMDYGEWTNNSRGTYNKWDGIARTTAQVYPGAWTAILVSLDNVGVWNLRTENLDNWYLGQETYIRVVNPEANNKTELPMPDNALFCGALGKLQKPQDISAGASIGKNTVKLLFTWLVFVCALIPIF

SEQ ID NO: 5607 - protein, 590 aa, Medicago truncatula
MASSPLFLFLINIFFLLTLSYAEDAFVPYEFEVSYITASPLGVPQQVIAINKQFPGPTINVTTNNNVAVNVHNKLDENLLIHWSGVQQRRSSWQDGVLGTNCPIPPKWNWTYQFQVKDQIGSFFYFPSLNFQRAAGGFGGFIINNRPVISVPFDTPEGDIVVFIGDWYTRNHTALRKALDDGKDLGMPDGVLINGKGPYRYNDTLVPEGIDFEQIDVKPGKTYRLRVHNVGISTSLNFRIQNHNLLLAETEGSYTVQQNYTSLDIHVGQSYSFLVTMDQNASSDYYIVASARFVNESRWQRVTGVGILHYSNSKGKARGHLPPGPDDQFDKTFSMNQARSIRWNVSASGARPNPQGSFRYGSINVTEIYVLKNKPPVKIDGKRRATLSGISFANPATPIRLADHYKLKGVYKLDFPTKPLTGSPRVETSVINGSFRGFMEIILQNNDTKMHTYHLSGYAFFVVGMDFGDWSENSRGTYNKWDGIARSTAQVYPGAWTAVLVSLDNVGVWNLRTENLDSWYLGQETYIRVVNPEPTNKTELPMPDNALKCGRLQHLQKPQKIISSASINGNGLKLLFTLVMFVCAIINIFQ

SEQ ID NO: 5608 - protein, 593 aa, Gossypium hirsutum
MTLSRFWGWFLIHIALFLSLCYAEDPFVFYDFEVTYITASPLGVPQQVIAINNKFPGPTINSTTNNNVVVNVRNKLDESLLMHWSGIQQRRSSWQDGVLGTNCPIPPKWNWTYQFQVKDQIGSFFYFPSLHFQRAAGGFGSFIINNRPIIPIPFDTPDGDIVILIGDWYTRNHTALRKALDAGKGLGMPDGVLINGKGPYRYNDTLVPDGIEYETINVHPGKTYRLRVHNVGISTSLNFRIQSHNLLLAESEGSYTVQQNYTSLDIHVGQSYSFLLTTDQNASSDYYIVASARFVNESQWKRVTGVAILRYSNSKGKASGPLPDPPQDEFDKTFSMNQARSIRWNVSASGARPNPQGSFRYGSINVTEVYVLRNKPPETIDGKRRATLSGISFVNPATPIRLADQYKIKGVYKLDFPNKPLTGPPKMETSVINGTYRGFMEVILQNNDTKMHTYHMSGYAFFVVGMDYGEWSENSRGTYNKWDGIARSTTQVYPGAWTAILISLDNVGVWNLRTENLDSWYLGQETYVRVVNPEATNKTELPMPDNALFCGALSKLQKPQDVSSSLATSIIEGRSKLFFTVLMIASTLFLISR

SEQ ID NO: 5609 - protein, 592 aa, Populus trichocarpa
MALCSKFLALFLIHTCLLLGLCSAADPFVSYDFEVSYITASPLGVPQQVIAINGKFPGPTINVTTNNNVAINVRNKLDDNLLIHWSGIQQRRSSWQDGLPGTNCPIPPKWNWTYQFQVKDQIGSFFYFPSLHMQRASGGFGSFIINNRAIIPIPFDTPHGDIVILIGDWYKRNHTALRKALDAGKDLGMPDGVLINGKGPYQYNATLVPDGIDYETIEVQPGKTYRIRVHNVGTSTSLNFRIQNHNLLLAESEGSYTVQQNYTSLDIHVGQSYSFLVTMDQNASTDYYIVASARFVNESQWKRVTGVGILHYTNSKGKAKGPLPDAPNDEFDKTFSMNQARSIRWNVSASGARPNPQGSFRYGSINVTDVYVLKNKPLVTINGKRRATLSGISFVNPATPIRLADQFKVKGVYKLDFPNKPLTGSSKMETSVINGTYRGFMEVILQNNDTKMQSYHLSGYAVFVVGMDYGEWTENSRGTYNKWDGIARSTVQVYPGAWTAILVSLDNVGVWNLRTENLDSWYLGQETYVRIVNPEETNKTELPIPDNALFCGALGKFQKPEDISFAVSITGNGSKLFFTLLMAVCALMSVFG

SEQ ID NO: 5610 - protein, 592 aa, Populus trichocarpa
MALCSKFLALFLIHTCLLLGLCSAADPFVSYDFEVSYITASPLGVPQQVIAINGKFPGPTINVTTNNNVAINVRNKLDDNLLIHWSGIQQRRSSWQDGLPGTNCPIPPKWNWTYQFQVKDQVGSFFYFPSLHMQRASGGFGSFIINNRAIIPIPFDTPHGDIVILIGDWYKRNHTALRKALDAGKDLGMPDGVLINGKGPYQYNATLVPDGIDYETIEVQPGKTYRIRVHNVGTSTSLNFRIQNHNLLLAESEGSYTVQQNYTSLDIHVGQSYSFLVTMDQNASTDYYIVASARFVNESQWKRVTGVGILHYTNSKGKAKGPLPDAPNDEFDKTFSMNQARSIRWNVSASGARPNPQGSFRYGSINVTDVYVLKNKPLVTINGKRRATLSGISFVNPATPIRLADQFKVKGVYKLDFPNKPLTGSSKMETSVINGTYRGFMEVILQNNDTKMQSYHLSGYAVFVVGMDYGEWTENSRGTYNKWDGIARSTVQVYPGAWTAILVSLDNVGVWNLRTENLDSWYLGQETYVRIVNPEETNKTELPIPDNALFCGALGKFQKPEDISFAVSITGNGSKLFFTLLMAVCALMSVFG

SEQ ID NO: 5611 - protein, 372 aa, Castanea mollissima
SFLSVLIHITLFVSLCYAADPFVNYELEVSYITASPLGVPQQVIAVNGKFPGPTINSTTNNNVVVNVRNKLDENLLIHWSGIQQRRSSWQDGVLGTNCPIPPKWNWTYQFQVKDQIGSFFYFPSLNFQRASGGYGGFIINNRDIIPIPFGTPDGDITIMIGDWYTRNHTALRKALDAGKDLGMPDGVLINGKGPYRYNDTLVPDGIEYETIEVHPGRTYRIRVHNVGVSTSLNFRIQSHNLLLAETEGSYTVQQNYTSLDIHVGQSYSFLLTTDQNASTDYYIVASARFVNESLWKRVTGVAILRYTNSKGKAKGPLPDSPNDEFDKTFSMNQARSIRWNVSASGARPNPQGSFRYGTINVTEIYVLKTNHL

SEQ ID NO: 5612 - protein, 591 aa, Citrus sinensis
MALCRGLSLLAIHIALLASLCSAADLFVYFDFEVSYITASPLGVPQQVIAINGKFPGPTINVTTNNNVVVNVRNKLDESLLIHWSGIQQRRSSWQDGLLGTNCPIPPKWNWTYQFQVKDQVGSFFYFPSLHFQRASGGFGGFIINNRAIIPIPFDTPDGDITILIGDWYTRNHTALRKTLDAGKGLGMPDGVLINGKGPYQYNTTLVPDGIDYETIEVHPGKTYRIRVHNVGISTSLNFRIQNHNLLLAETEGSYTVQQNYTSLDIHVGQSYSFLVTMDQNASTDYYIVASARFVNESQWKRVTGVAILHYTNSKGKARGPLPEGPNDEFDKTFSMNQARSIRWNVSASGARPNPQGSFRYGSINVTEVYVLRNKPPEMIDGKRRATLSGISFVNPSTPIRLADWFKVKGAYKLDFPTKPVTGPPRMETSVINGTYRGFMEVILQNNDTKMHAYHMSGYAFFVVGMDYGEWTDNSRGTYNKWDGIARTTTQVYPGAWTAILVSLDNVGIWNLRTENLDSWYLGQETYVRVVNPEATNKTEFPIPDNALFCGALSHLQKPEDISAATAITGDRLKMFFTLLMTMCAMLVLFH

SEQ ID NO: 5613 - protein, 592 aa, Populus trichocarpa
MALRSKFLALFLIHICLLLSLCLAADPFVSYDFEVSYITASPLGVPQQVIAINGKFPGPTINVTTNNNVAINIKNKLDENLLMHWSGIQQRRSSWQDGVLGTNCPIPPKWNWTYQFQVKDQIGSFFYFPTLHMQRASGGFGSFVINNRAIIPIPFDTPHGDIVILIGDWYKRNHTALRKALDAGKDLGMPDGVLINGKGPYQYNTTLVPDGIDYETIEVQPGKTYRIRVHNVGTSTSLNFRIQNHNLLLAESEGSYTVQQNYTSLDIHVGQSYSFLVTMDQNASTDYYIVASARFVNESQWKRVTGVAILHYTNSKGKAKGPLPEAPNDEFDKTFSMNQARSIRWNVSASGARPNPQGSFRYGSINVTDVYVLKNKPLVTINGKRRATLSGISFVNPTTPIRLADQFKVKGAYKLDFPETPLTGPPKMATSVINGTYRGFMEVILQNNDTKMHSYHLSGYAVFVVGMDYGEWTENSRGTYNKWDGIARSTVQAYPGAWTAILVSLDNVGVWNLRTENLDSWYLGQETYIRIVNPEETNKTELPIPDNALFCGELSKLQKPEDISFAASITGNRSKLLFMLLMAVCALMSVFG

SEQ ID NO: 5614 - protein, 593 aa, Ricinus communis
MALCKFFALFLLIHICLLLSLCSAEDPFVSYNFEVSYIEASPLGVPQQVIAINGKFPGPTINVTTNNNVVINVRNKLDENLLMHWSGIQQRRSSWQDGLPGTNCPIPPKWNWTYQFQVKDQIGSFFYFPSLHMQRASGGYGGFIINNRAVISIPFDTPHGDIVILIGDWYKRNHTALRKALDAGKDLGMPDGVLINGKGPYQYNTTLVPDGIDYETIEVQPGKTYRLRVHNVGTSTSLNFRIQNHNLLLAESEGSYTVQQNYTSLDIHVGQSFSFLVTMDQNASSDYYIVASARFVNESQWRRVTGVAVLHYTNSKGKAKGPLPDAPNDEFDKTFSMNQARSIRWNVSASGARPNPQGSFRYGSINVTEVYLLKNKPPVTINGKKRTTLSGISFVNPSTPIRLADQFKVKGVYKLDFPTKPLTGPPKMETSVINGTYRGFMEVILQNNDTKMQSYHMSGYAFFVVGMDYGEWSENSRGTYNKWDGIARSTVQVYPGAWAAILVSLDNVGVWNLRTENLDSWYLGQETYVRVVNPEATNKTELPLPENALYCGALSKLQKPQDISSFAVSIKGDRSKLLFALLMIASAVMSIFS

SEQ ID NO: 5615 - protein, 591 aa, Cucumis sativus
MASFGYLSLFLLPFCLFLTFSSAADPFAFFDFEVSYITASPLGVPQQVIAINGEFPGPTVNVTTNNNVVINVRNKLDESMLMHWSGVQQRRSSWQDGVPGTNCPIPPKWNWTYQFQVKDQIGSFFYFPSLHFQRASGGFGGIIINNRDVIPIPFSTPDGDITILMGDWYTRNHTALRKSLDDGKDLGMPHGVLINGKGPYRYNDTLVPDGIDHETIEVHPGKTYRIRVHNVGISTSLNFRIQNHNLLLAETEGSYTVQQNYTSLDIHVGQSYSFLVTMDQNASTDYYIVASARFVNESLWKRVTGVAILHYSNSKGKAAGPLPEAPKDEFDKTFSMNQARSIRWNVSASGARPNPQGSFRYGSINVTDVYVLKNKPPVSINGKMRTTLSGISFVNPSTPIRLADQFKLKGVYKLDFPTRPLTGPPKAETSVINGTYRGFMEVILQNNDTKMQSYHMNGYAFFVVGMDYGEWSENSRGTYNKWDGIARSTIQVYPGAWTAILVSLDNVGIWNIRTENLDSWYLGQETYVRVVNPEATNKTELPMPDNALFCGQLGKLQKPQDISSATSITGDRLKMLFTLLMIISTVICALQ

SEQ ID NO: 5616 - protein, 589 aa, Gossypium hirsutum
MALSKFLGLFLIHIALLSSSCFAADPFVFYDFEVSYITASPLGVPQQVIAINNKFPGPTINSTTNNNVVINVRNKLDESLLLHWSGIQQRRSSWQDGLPGTNCPIPPKWNWTYQFQVKDQIGSFFYFPSLHFQRAAGGFGGFIINNRDIIPIPFGSPDGDITILIGDWYTRNHTALRKALDAGKDLGMPDGVLINGKGPYQYNDTLVPDGIDYETIDVHPGKTYRLRVHNVGISTSLNFRIQSHNLLLAETEGSYTVQQNYTSLDIHVGQSYSFLLTTDQNASSDYYIVASARFVNESQWKRVTGVAILRYSNSKGKAAGPLPDPPQDEYDKTFSMNQARSIRWNVSASGARPNPQGSFRYGSINVTEIFVLKNKPPVTIDGKRRTTLSGISFVNPATPIRLADQFKVKGVYKLDFPSRPLTGPPKMETSLINGTFRGFMEVILQNNDTKVQTYHLSGYAFFVVGMDYGEWSENSRGTYNKWDGIARSTTQVYPGAWTAILISLDNVGVWNLRTENLDSWYLGQETYIRVVNPEVTNKTELPMPDNVLYCGALSKRQKPQDISFATSITTSSSKLFLAVLMVASALLFH

SEQ ID NO: 5617 - protein, 589 aa, Gossypium hirsutum
  misc_feature (573)..(573): Xaa can be any naturally occurring amino acid
  misc_feature (584)..(584): Xaa can be any naturally occurring amino acid
MALSKFLGLFLIHIALLSSSCFAADPFVFYDFEVSYITASPLGVPQQVIAINNKFPGPTINSTTNNNVVINVRNKLDESLLLHWSGIQQRRSSWQDGLPGTNCPIPPKWNWTYQFQVKDQIGSFFYFPSLHFQRAAGGFGGFIINNRDIIPIPFGSPDGDITILIGDWYTRNHTALRKALDAGKDLGMPDGVLINGKGPYQYNDTLVPDGIDYETIDVHPGKTYRLRVHNVGISTSLNFRIQSHNLLLAETEGSYTVQQNYTSLDIHVGQSYSFLLTTDQNASSDYYIVASARFVNESQWKRVTGVAILRYSNSKGKAAGPLPDPPQDEYDKTFSMNQARSIRWNVSASGARPNPQGSFRYGSINVTEIFVLKNKPPVTIDGKRRTTLSGISFVNPATPIRLADQFKVKGVYKLDFPSRPLTGPPKMETSLINGTFRGFMEVILQNNDTKVQTYHLSGYAFFVVGMDYGEWSENSRGTYNKWDGIARSTTQVYPGAWTAILISLDNVGVWNLRTENLDSWYLGQETYIRVVNPEVTNKTELPMPDNVLYCGALSKRQKPQDISFATSITTSSXKLFLAVLMVAXALLFH

SEQ ID NO: 5618 - protein, 577 aa, Manihot esculenta
MSLCSSFAAFFLIHICLLLTLCFAEDPFVTYSFEISYITASPLGVPQQVIAINGKFPGPTINVTTNNNVVVNVRNKLDESLLMHWSGIQQRRSSWQDGLAGTNCPIPPKWNWTYQFQVKDQIGSFFYFPSLHMQRASGGYGSFIINNRPIIPIPFDTPFGDIVILIGDWYKRNHTALRRALDEGKDLGMPDGVLINGKGPYQYNTTLVPDGIDYETIEVHPGKTYRLRVHNVGTSTSLNFRIQNHNLLLAESEGSYTVQQNYTSLDIHVGQSYSFLVTMDQNASSDYYIVASARFVNESQWKRVTGVAVLHYTNSKGKAKGPLPDAPNDEFDKTFSMNQARSIRWNVSASGARPNPQGSFRYGSINVTEVYVLKNKPPVTINGKNRTTLSGISFGVYKLDFPSKPLEGPPKMETSVINGTYRGFMEVILQNNDTKMQSYHMSGYAFFVVGMDYGEWTDNSRGTYNKWDGIARSTIQVYPGAWTAILVSLDNVGVWNLRTENLDSWYLGQETYVRVVNPEATNKTELPLPENALFCGSLSRMQKSQDISSFAASIKGDKSKLFLTLLMIACATMCIFR

SEQ ID NO: 5619 - protein, 303 aa, Glycine max
MEGGKRGTILVTNDDGIDAPGLRALVHSLVNANLFNVLVCAPDSEKSAVSHSITWLHPVAVKQVQIEGTTAFAVSGTPADCASLGISKALFPTVPDLVVSGINKGSNCGYHIVYSGTVAGAREAFFNDILSISISYDWVKGKSKLQDFTLAAQVCLPIISALLVETKNQSYPRKCFLNIDVPNNVPNHKGYKLTKQGKSIIKTGWRQVTSETEGPKMSSDMTNTDTETSKNFDSSSASPEHLLFAREVIGSVLDEDDTDYKCLREGYITVTPLAALTHVEVDCQAYFKNWLQSVPELPSSSSL

SEQ ID NO: 5620 - protein, 301 aa, Cajanus cajan
MEGGKRSTILITNDDGIDAPGLRALVHSLVNTNLFNVLVCAPDSEKSAVSHCITWLHPIAVKQVNINGTTAFAVSGTPADCASLGVSKALFPTVPDLVVSGINKGSNCGYHIVYSGTVAGAREAFFNDVPSISVSYDWIKGKSNLQDFTLAAQVCIPIISAVLVEIKNPSFPRRCFLNIDVPNNVANHKGYKLTKQGKSIIKMGWRQVTSETEGQKMSSDMTNTDTETPKSFESSVSPEHLLFAREVRGSVLDDDDTDYRSLQEGYITVTPLAALSHAEVNCQTFFKNWLQSVPEPSPSSL

SEQ ID NO: 5621 - protein, 300 aa, Phaseolus coccineus
  misc_feature (277)..(277): Xaa can be any naturally occurring amino acid
MEGGKLGTILITNDDGIDAPGLRALVQSLVVANLFNLQVCAPDSEKSAVSHSITWLHPIAAKQVKIDGTTAFAVSGTPADCASLGVSKALFPTVPDLVVSGINKGSNCGYHIVYSGTVAGAREAFFNDVPSISISYNWVKGKSDLNDFTLAAQVCLPIISAVLVEAKNPSYPRKCFLNVDVPTVVPNHKGYKLTKQGKSIIKMGWKQVTSETEGQKMSSDMTNTDTDISKNFDPSSVSPEHLLFTREVRGSHLDDDESDYRSLQEGYITVTPLAALXHAEVDCQAYFKNWLQSVPGPSSL

SEQ ID NO: 5622 - protein, 315 aa, Vigna unguiculata
EERSCLAITGDMEGEKIGTILITNDDGIDAPGLRALVQSLVSTDLFNIQVCAPDSEKSAVSQSITWLQPVAVKQVNMDGTTAFAVSGTPADCASLGVSKALFPTVPDLVVSGINMGSNCGYHIVYSGTVAGAREAFFNDVPSISISYNWIKGKSNLNDFTLAAQVCLPIISSVLVEAKNPSYPRKCFLNVDVPNDVANHKGYKLTKQGKSIIKMGWRQVTSETEGQKMSSDMTNTDAEIPKNFDPSSISPEHLLFAREVRGSVVDDDDDTDYRRLLEGYITVTPLAAVSNAEVDCQDYFKNWLQSVPELSSSSCL

SEQ ID NO: 5623 - protein, 307 aa, Lotus japonicus
MEESKRATILITNDDGIDAPGLRALVHSLVTTNLFNILVCAPDSEKSAVSHGITWLHPITAKQIQIDGATSAFAVSGTPADCTSLGVSKALFPTLPDLVVSGINKGSNCGYHIVYSGTVAGAREAFFNDVPSISISYDWIKGKSNLQDYALAAQVCIPIISAVLVEIKNESYPKKCFLNIDVPNNVANHKGYKLTKQGKSIVRMGWKQVTSETEGRKMTSDMTNTDTDTDTPKNVGASSVSPEHLSFVREVRGYQLDDDDDTDHSSLQEGYISVTPLAALSHAEVDCQTYFKDWLQSVPEIPSSSAL

SEQ ID NO: 5624 - protein, 299 aa, Arachis hypogaea
NRATILVTNDDGIDAPGLRALVHSLVATNLFKIQVCAPDSEKSAVSHSITWLHPIAAKQVHIDGTTAFAVSGTPADCTSLGISKALFPTVPDLVVSGINKGSNCGYHIVYSGTVAGAREAFFNGIPAISVSYDWVKGKSNVHDFTLAAQACIPIISAVLVEIKNQSFPQRCFLNIDVPNNAANHKGYKLTKQGNSIVRMGWKQVTSETEERKMSSDMTNIDTETPKDTCTSSVSSEQLLFAREVRGYVLDHEDTDHKSLQEGYITVTPLAALSPAEVDCQAYFREWLQSVTELPSSSAL

SEQ ID NO: 5625 - protein, 168 aa, Glycine max
MLNLLVVLQKDRFNPRFYIAAATDNMSLQKAQLLENSLAAENATRVTDTAQFMKIYRSREVGQSYITSVWTTLVAMVHALWLMIKIRPEVILCNGPGTCIPLCAIAFIFKVLGIRWSLIFYVESIARVRRLSLSGLLLYKLRMADQLFVQWPQLQRQYPRATYVGRLM

SEQ ID NO: 5626 - protein, 233 aa, Glycine max
MDKSNGCRFSSVTSIAVFSSAIFVVTLILVRLLYVMYCSSRSLSKRVLKPASTLIILGSGGHTAEMLNLLAVLQKDRFKPRFYIAAATDNMSLQKAQLLENSLAAENAARVTDTAQFMKIYRSREVGQSYITSIWTTLIAMVHALWLMIKIRPEVILCNGPGTCIPLCSIAFIFKILGIRWSSIFYVESIARVRRLSLSGLLLYKLRMVDQLFVQWPQLQRQYPRATYVGRLM

SEQ ID NO: 5627 - protein, 244 aa, Phaseolus coccineus
MDKCNGCGFSNMASIAVFSSAIFVVSLILVRLLYVIYHSRRPLSKRASKPVSTLIILGSGGHTAEMLNLLAVLRKDRFNPRFYIAAATDNMSLEKAQLFENSLATENATRVTDTAQFMKIYRSREVGQSYITSIWTTLIAMVHALWLMIKIRPEVILCNGPGTCIPLCAIAFIFKLLGIRWSSIFYVESIARVRRLSLSGLLLYLPGQWLINFLFSGNSCNGNIPELPMLVDSCNQLVLNSCTI

SEQ ID NO: 5628 - protein, 230 aa, Vigna unguiculata
  misc_feature (12)..(12): Xaa can be any naturally occurring amino acid
MDKCNGCSVSSXAVFSSSIFVVSLILVRLLYVIYHSRRPLSKRASKPVSTLIILGSGGHTAEMLNLLAVLRKDRFNPRFYIAAATDNMSLEKAQLLENSLATENATRVTQTSQFMKIYRSREVGQSYITSIWTTLIAMGHALWLMIKIRPEVILCNGPGTCIPLCAIAFIFKVVGIKWSSIFYVESIARVRRLSLSGLLLYKFRMADQLFVQWPQLQRQYPRATYVGRLM

SEQ ID NO: 5629 - protein, 233 aa, Vigna unguiculata
  misc_feature (19)..(19): Xaa can be any naturally occurring amino acid
  misc_feature (44)..(44): Xaa can be any naturally occurring amino acid
  misc_feature (48)..(48): Xaa can be any naturally occurring amino acid
  misc_feature (139)..(139): Xaa can be any naturally occurring amino acid
MGKCNGCSFSIVSSFGVFXSAIFVVSLILVRLLYVIYHSRRPLXKRGXKPVSTLIILGSGGHTAEMINLLAVLQKDRFYPRFYIAAATDIMSLLKAQMLENSLTSENASGVTDTAHFMKIYRSREVGQSYITSVWTTLXALVHALWLMVKIRPEVILCNGPGTCIPLCAIAFIFKVLGIRWSSIFYVESIARVRRLSLSALLLYKLRMADQLFVQWPQLQRQYPRVTYVGRLM

SEQ ID NO: 5630 - protein, 233 aa, Medicago truncatula
MEKGNGCCFSSLSSIATLSSVAFVVILILVRVVHVIYSSGRPLSKRASKPVSTLIILGSGGHTAEMLNLLAVLQKDRFKPRFYIAAATDNMSLQKAILLENSLASESGTAVADTAQFMKIYRSREVGQSYITSIWTTLIAIVHALWLMIKIRPEVILCNGPGTCIPLCVIAFIFKVLGIRWSSIFYVESIARVRRLSLSGLLLYKLWLADQIFVQWPQLQQQYPRATYVGRLM

SEQ ID NO: 5631 - protein, 233 aa, Arachis hypogaea
MDKGNGCSFSAVTSTAIISSVIFVITLILVRVLFVIYCSSRPMSRRAKKPVSTLIILGSGGHTAEMLDLLAVLQKDRFYPRFYIAAATDNMSLQKAELLENSLAAENGTPITNAGKFMKIYRSREVGQSYITSIWTTLVAMVHALWLMIKIRPEVILCNGPGTCIPICAIAFVFKVLGIRWSSIFYVESIARVRRLSLSGLLLYKLRIADQLFVQWPRLQQQYPRAIYVGRLM

SEQ ID NO: 5632 - protein, 192 aa, Solanum tuberosum
MAALKLILLAAFLSLFNFTANSTALPTSFIKSSCKITTYPQVCVTSLAVYAPTIKRSPQQLAQTALSVSLDRAQSAHTFITKLNKFKGLKQREYAALKDCLEEMSETIDRINKSVKELKSMGSARGKDFQWRMSNIETWISAAITNENTCADGFAGRALNGRIKTSIRARVTHVTQVTSNALALINQFAAKH

SEQ ID NO: 5633 - protein, 192 aa, Solanum phureja
MAALKLIVLAAFLSLFNFTANSTALPTSFIKSSCKITTYPQVCVSSLAVYAPTIKRSPQQLAQTALSVSLDRAQSAHTFITKLNKFKGLKQREYAALKDCLEEMSETIDRINKSVKELKSMGSARGKDFQWRMSNIETWISAAITNENTCADGFAGRALNGRIKTSIRARVTHVTQVTSNALALINQFAAKH

SEQ ID NO: 5634 - protein, 66 aa, Unknown
  Sequence found in Organisms: Solanum tuberosum, Solanum phureja
MCLVFVCDEDERVLQRQAAPGACPYCGGMVQALDMESQWRFCFVPLYFKTKRRYYCTLCTRRLIIQ

SEQ ID NO: 5635 - protein, 66 aa, Arachis hypogaea
MCLVFVCDEDERVLARQPAPGACPYCGGMVQATDVQKQWRFCFLPIYFKTKRRYYCTMCTRTLQIQ

SEQ ID NO: 5636 - protein, 66 aa, Glycyrrhiza uralensis
MCLVFVCDEDERVLGRQAAPGACPYCGGMVQAIDVESTWRFCFLPFCYKTKRRYYCTLCTRRLEVL

SEQ ID NO: 5637 - protein, 68 aa, Capsicum annuum
HEASCRFVCDEDERVLQRQAAPGACPYCGGMIQALDVESQWRFCFLPLYFKTKRRYYCTLCTRRLIVQ

SEQ ID NO: 5638 - protein, 66 aa, Glycine max
MCLVFVCDEEERVLGRQTAPGACPYCGGMVQAIDVESQWRFCFLPLCFKTKRKYYCTMCTRRLEVI

SEQ ID NO: 5639 - protein, 66 aa, Coffea canephora
MCLVFVCDEDERVLARQIAPGACPYCGGMVQALDVEKEWRFCFVPLYFKAKRKYFCTICARRLTIQ

SEQ ID NO: 5640 - protein, 64 aa, Heritiera littoralis
LVFVCDEDERVISRQPAPGACPYCGGMVQAMDVESQWRFCFLPLYFRTKRRYYCSLCTRRLVVQ

SEQ ID NO: 5641 - protein, 66 aa, Unknown
  Sequence found in Organisms: Ipomoea nil, Ipomoea batatas
MCLVFVCDEDERVVGKQVAPGACPYCGGVVQAMDVESQWSFCFLPIYFKNKRRYYCTLCARRLVIQ

SEQ ID NO: 5642 - protein, 66 aa, Cicer arietinum
MCLMFVCDEDERVLGRQLAPGACPYCGGMVQAIDVETQWRFCFLPFCFKTKRRYYCTICTRRLEVV

SEQ ID NO: 5643 - protein, 66 aa, Gossypium hirsutum
MCLVFVCDEDERVISRQPAPGACPYCGGMVQAMDVESQWRFCFLPLYFKTKRRYYCSFCARRLVVH

SEQ ID NO: 5644 - protein, 66 aa, Gossypium hirsutum
  misc_feature (57)..(57): Xaa can be any naturally occurring amino acid
MCLVFVCDEDERVISRQPAPGACPYCGGMVQAMDVESQWRFCFLPLYFKTKRRYYCXFCARRLVVH

SEQ ID NO: 5645 - protein, 237 aa, Saccharum officinarum
MLAVFSGEVVEVPAELVAAGSRTPSPKTRASELVARFLGTCPAAVSVRLAADLGHLAYSNANQALLRPRSFAAKDEVFCLFQGVLDNLGRLSQQYGLSKGANEVLLVIEAYKTLRDRAPYPASFMLSQLAGTYAFVLFDKSTNSLLVASDPEGKVPLFWGITADGCVAFSDDIDMLKGSCGKSLAPFPQGCFYSNALGGLKCYENPKNKVTAVPANEEEICGATFQVEGSTVLTALH

SEQ ID NO: 5646 - protein, 236 aa, Saccharum officinarum
MLAVFSGGVVEVPAELVAAGSRTPSPKTRASELVGRFLGASEPAVSVQLGDLGHLAYSHTNQALLRPRSFAAKDEVFCLFQGVLDNLGRLSQQYGLSKGANEVLLVIEAYKTLRDRAPYPASFMLSQLAGTYAFVLFDKSTNSLLVASDPEGKVPLFWGITADGCVAFSDDIDMLKGSCGKSLAPFPQGCFYSNALGGLKCYENPKNKVTAVPANEEEICGATFQVEGSTVLTALH

SEQ ID NO: 5647 - protein, 237 aa, Saccharum officinarum
  misc_feature (14)..(14): Xaa can be any naturally occurring amino acid
  misc_feature (89)..(89): Xaa can be any naturally occurring amino acid
MLAVFSGEVVEVPXELVAAGSRTPSPKTRACELVTRLLGTCPAGVFVRLAGDLGHLVYSNANQGLLRPMSFAAKDEVFCLFQGVLDNLXRLSQQYGLSKGANEVLLVIEAYKTLRDRAPYPASFMLSQLAGTYAFVLFDKSTNSLLVASDPEGKVPLFWGITADGCVAFSDDIDMLKGSCGKSLAPFPQGCFYSNALGGLKCYENPKNKVTAVPANEEEICGATFQVEGSTVLTALH

SEQ ID NO: 5648 - protein, 235 aa, Zea mays
MLAVFSGEVVEVPAELVAAGSRTPSPKTKASELVARFLGTSCPAAVSVRLADLGHLAYSHANQALLRPRSFAAKDEVFCLFEGVLDNLGRLSQQYGLSKGANEVLLVIEAYKALRDRAPYPASLMLAQLAGAYAFVLFDASTNSLLVASGGDVPLFWGVTADGCVAFSDDIDVLKGSCGKSLAPFPQGCFYSNALGGLKCYENPKNKVTAVPANEEEICGATFQVEGATVLTALH

SEQ ID NO: 5649 - protein, 236 aa, Panicum virgatum
MLAVFSGEVVEVPAELVAAGSRTPSPKTRASELVSRFLGSSEPAVSIQLADLGHLAYSHTNQALLRPRSFAAKDEIFCLFEGVLDNLGRLSQQYGLSKGTNEVVLVIEAYKTLRDRAPYPASFMLSQLTGSYAFVLFDKSTNSLLVASDPEGKVPLFWGITADGCVAFSDDIDMLKGSCGKSLAPFPQGCFYSNALGGLKCYENPKNKVTAVPANEEEICGATFKVEGSTVLSALH

SEQ ID NO: 5650 - protein, 238 aa, Saccharum officinarum
MLAVFSGGVVEVPAELVAAGSRTPSPKTRASELVGRFLGASEPAVSVQLGDLGHLAYSHTNQALLRPRSFAAKDEVFCLFEGVLDNLGRLSQQYGLSTKGANEVLLVIEAYKTLRDRAPYPASFMLAQLTGSYAFVLFDKSTNSLLVASDPEGKVPLFWGITADGCVAFSDDIDMLKGSCGKSLAPFPQGCFYSNALGGLKCYENPKHKVTAVPADEEEICGATFKVEGSTVLTALHY

SEQ ID NO: 5651 - protein, 237 aa, Saccharum officinarum
  misc_feature (6)..(6): Xaa can be any naturally occurring amino acid
MLAVFXGGVVEVPAELVAAGSRTPSPKTRASELVGRFLGASEPAVSVQLGDLGHLAYSHTNQALLRPRSFAAKDEVFCLFEGVLDNLWRLSQQYRLFTKGANEVLLVIEPYKTLRDRAPYPASFMLSQLAGTYAFVLFDKSTNSLLVASDPEGKVPLFWGITADGCVAFSDDIDMLKGSCGKSLAPFPQGCFYSNALGGLKCYENPKNKVTAVPANEEEICGATFQVEGSTVLTALH

SEQ ID NO: 5652 - protein, 236 aa, Panicum virgatum
MLAVFSGEVVEVPADLVAAGSRTPSPKTRASELVSRFLGSSEPAVSIQLADLGHLAYSHTNQALLRPRSFAAKDEIFCLFEGVLDNLGRLSQQYGLSKGTNEVVLVIEAYKTLRDRAPYPASFMLSQLTGSYAFVLFDKSTNSLLVASDPEGKVPLFWGITADGCVAFSDDIDMLKGSCGKSLAPFPQGCFYSNALGGLKCYENPKNKVTAVPANEEEICGATFKVEGSTVLTALH

SEQ ID NO: 5653 - protein, 237 aa, Pennisetum glaucum
MLAVFSGEVVEVPAELVAAGSRTPSPKTRASELVTRFLGTSGSDPAVSVQLADLGHLAYSHTNQALLRPRSFAAKDEIFCLFEGVLDNLGRLSQQYGLSKGANEVVLVIEAYKTLRDRAPYPASFMLSQLAGSYAFVLFDKSTRSLLVASDPEGKVPLFWGVTADGCVAFSDDIDVLKGSCGKSLAPFPQGCFYSNALGGLKCYENPKHKVTAVPANEEEICGATFKVEGTTVLTAL

SEQ ID NO: 5654 - protein, 238 aa, Sorghum bicolor
MLAVFSGGVVEVPAELVAAGSRTPSPKTRASELVGRFLGASEPAVSVQLGDLGHLAYSHTNQALLRPRSFAAKDEVFCLFEGVLDNLGRLSQQHGLSTKGANEVLLVIEAYKTLRDRAPYPASFMLAQLTGSYAFVLFDKSTNSLLVASDPEGKVPLFWGITADGCVAFSDDIDMLKGSCGKSLAPFPQGCFYSNALGGLKCYENPKHKVTAVPADEEEICGATFKVEGSTVLTALHF

SEQ ID NO: 5655 - protein, 238 aa, Saccharum officinarum
MLAVFSGGVVEVPAELVAAGSRTPSPKTRASELVGRFLGASEPAVSVQLGDLGHLAYSHTNQALLRPRSFAAKDEVFCLFEGVLDNLGRLSQQYGLSTKGANEVLLVIEAYKTLRDRAPYPASFMLAQLTGSYAFVLFDKSTNSLLVASDPEGKVPLFWGITADGCVAFSDDIDMLKGSCGKSLAPFPQGCFYSNALGGLKCYENPKHKVTAVPADEEEICGATFKVEGFTVLTALHY

SEQ ID NO: 5656 - protein, 238 aa, Triticum aestivum
  misc_feature (208)..(208): Xaa can be any naturally occurring amino acid
MLAVFSGGVVEVPAELVAAGSRTPSPKTRASELVGRFLGASEPAVSVQLGDLGHLAYSHTNQALLRPRSFAAKDEVFCLFEGVLDNLGRLSQQHGLSTKGANEVLLVIEAYKTLRDRAPYPASFMLAQLTGSYAFVLFDKSTNSLLVASDPEGKVPLFWGITADGCVAFSDDIDMLKGSCGKSLAPFPQGCFYSNALGGLKCYENPKXKVTAVPADEEEICGATFKVEGSTVLTALHF

SEQ ID NO: 5657 - protein, 238 aa, Zea mays
MLAVFSGQVVEVPAELVAAGSRTPSPKTKASQLVGRFLAASEPAVSVQLGDHGHLAYSHTNQALLRPRSFAAKDEVFCLFEGVLDNLGRLSQQHGLSSKGANEVLLVIEAYKTLRDRAPYPASFMLAQLTGSYAFVLFDKSTNSLLVASDPEGRVPLFWGITADGCVAFSDDIDMLKGSCGKSLAPFPQGCFYSNALGGLKCYENPKHKVTAVPADEEEICGATFKVVEGSTVLTALH

SEQ ID NO: 5658 - protein, 236 aa, Pennisetum glaucum
MLAVFSGGVVEVPAELVAAGSRTPSPKTRASELVSRFLGSSEPAVSMNLGDLGHLAYSHTNQALLRPRSFAAKDEIFCLFEGVLDNLGRLSQQHGLSKGTNEVVLVIEAYKTLRDRAPYPASFMLSQLAGSYAFVLFDKSTNSLLVASDPEGKVPLFWGITADGCVAFSDDIDMLKGSCGKSLAPFPQGCFYSNALGGLKCYENPKHKVTAVPANEEEICGATFKVEGSTTVLTAL

SEQ ID NO: 5659 - protein, 236 aa, Leymus cinereus x Leymus triticoides
MLAVFSGEVVEVPAELVAAGSRTPSPKTRASELVKRFLAGADPAVSVELGSLGNLAYSHANQSLLLPRSFAAKDEIFCLFEGVLDNLGRLSQQYGLSKGGNEVLLVIEAYKTLRDRAPYPASFMLSQLTGSYAFVLFDKSTSSLLVASDPEGKVPLFWGITADGCVAFSDDIDLLKGSCGKSLAPFPQGCFYWNALGGLKSYENPKNKVTAVPADEEEICGATFMVEGSTVLAALQ

SEQ ID NO: 5660 - protein, 236 aa, Pseudoroegneria spicata
MLAVFSGEVVEVPAELVAAGSRTPSPKTRASELVKRFLAGADPAVSVELGSLGNLAYSHANQSLLRPRSFAAKDEIFCLFEGVLDNLGRLSQQYGLSKGGNEVLLVIEAYKTLRDRAPYPASFMLSQLTGSYAFVLFDKSTSSLLVASDLEGKVPLFWGITADGCVAFSDDIDLLKGSCGKSLAPFPQGCFYWNALGGLKSYENPKNKVTAVPADEEEICGATFMVEGSTVLAALQ

SEQ ID NO: 5661 - protein, 241 aa, Panicum virgatum
MLAVFSGEVVEVPAELVAAGSRTPSPKTRATELVTRFLGSSEPAVCVRLADLGHLAYSHTNQALLRPRSFAAKDEIFCLFEGVLDNLGRLSQQYGLSKGANEVVLVIEAYKTLRDRAPYPASFMLSQLTGSYAFVLFDKSTNSLLVASDPEGKVPLFWGITADGCVAFSDDIDMLKGSCGKSLAPFPQGCFYSNALGGLKCYENPKNKVTAVPANEEEICGATFKVEGSTVLTSLGGDLRV

SEQ ID NO: 5662 - protein, 236 aa, Triticum aestivum
MLAVFSGEVVEVPAELVAAGSRTPSPKTRASELVKRFLAGAEPAVSVELGSLGNLAYSHANQSLLLPRSFAAKDEIFCLFEGVLDNLGRLSQQYGLSKGGNEVLLVIEAYKTLRDRAPYPASFMLSQLTGSYAFVLFDKSTSSLLVASDPEGKVPLFWGITADGCVAFSDDIDLLKGSCGKSLAPFPQGCFYWNALGGLKSYENPKNKVTAVPADEEEICGATFMVEGSTVVAALQ

SEQ ID NO: 5663 - protein, 236 aa, Triticum aestivum
MLAVFSGEVVEVPAELVAAGSRTPSPKTRASELVKRFLAGNDPAVSVELGSLGNLAYSHANQSLLLPRSFAAKDEIFCLFEGVLDNLGRLSQQYGLSKGGNEVLLVIEAYKTLRDRAPYPASFMLSQLTGSYAFVLFDKSTSSLLVASGPEGKVPLFWGITADGCVAFSDDIDLLKGSCGKSLAPFPQGCFYWNALGGLKSYENPKNKVTAVPADEEEICGATFMVEGSTVVAALQ

SEQ ID NO: 5664 - protein, 236 aa, Triticum aestivum
MLGVFSGEVVEVPAELVAAGSRTPSPKTRASELVKRFLAGAEPAVSVELGSLGNLAYSHANQSLLLPRSFAAKDEIFCLFEGVLDNLGRLSQQYGLSKGGNEVLLVIEAYKTLRDRAPYPASFMLSQLTGSYAFVLFDKSTSSLLVASDPEGKVPLFWGITADGCVAFSDDIDLLKGSCGKSLAPFPQGCFYWNALGGLKSYENPKNKVTAVPADEEEICGATFMVEGSTVVAALQ

SEQ ID NO: 5665 - protein, 238 aa, Cynodon dactylon
MLAVFSGAVVEVPAELVAAGSRTPSPKTRASELVNRFLGSVEPAVSMQLGDLGSLAYSHTNQALLRPRSFAAKDEIFCLFEGVLDNLGRLNQQYGLSKGANEVLLVIEAYKTLRDRAPYPVSFMLSQLTGSYAFVLFDKSTSSLLVASDPEGKVPLFWGITADGCVAFSDDIDMLKGSCGKSLAPFPQGCFYSNALGGLKCYENPKNKVTAVPANEEEICGATFKVEGSTFLTALGSI

SEQ ID NO: 5666 - protein, 236 aa, Hordeum vulgare
MLAVFSGEVVEVPAELVAAGSRTPSPKTRASELVKRFLAGADPAVSVELGSLGNLAYSHVKESLLLPRSFAAKDEIFCLFEGVLDNLGRLSQQYGLSKGSNEVLLVIEAYKTLRDRAPYPASFMLSQLAGSYAFVLFDKSTSSLFVASDPEGKVPLFWGITADGCVAFSDDIDLLKGSCGKSLAPFPQGCFYWNALGGLKSYENPKNKVTAVPADEEEICGATFMVEGSTVLAALQ

SEQ ID NO: 5667 - protein, 241 aa, Panicum virgatum
MLAVFSGEVVEVPAELVAAGSRTPSPKTRASELVTRFLGSSEPAVSVQLAGLGHLAYSHTNQALLRPRLFAAKDEIFCLFEGVLDNLGRLSQQYGLSKGTNEVVLVIEAYKTLRDRAPYPASFMLSQLTGSYAFVLFDKSTNSLLVASDPEGKVPLFWGITADGCVAFSDDIGMLKGSCGKSLAPFPQGCFYSNALGGLKCYENPKNKVTAVPADEEEICGATFKVEGSTALTSLGGDLRV

SEQ ID NO: 5668 - protein, 236 aa, Festuca arundinacea
  misc_feature (42)..(42): Xaa can be any naturally occurring amino acid
  misc_feature (196)..(196): Xaa can be any naturally occurring amino acid
MLAVFSGEVVEVPSELVAAGSRTPSPKTRASELVKRFLAGAXPAVSVELGSLGNLAYSHANQSLLLPRSFAAKDEIFCLFEGVLDNLGRMSQQYGLSKGGNEVLLVIEAYKTLRDRAPYPASFMLSQLTGSYAFVLFDKSTSSLLVASDPEGKVPLFWGITADGCVAFSDDIDLLKGSCGKSLAPFPQGCFYWNAXGGLKSYENPKNKVTAVPADEEEICGATFMVEGSTVLTALQ

SEQ ID NO: 5669 - protein, 236 aa, Avena sativa
MLAVFSGEVVEVPAELVAAGSRTPSPKTRSSELVKRFLAGAEPAVSVELGSLGNLAYSHANQSPLLPRSFAAKDEIFCLFEGVLDNLGRLSQQYGLSKGGNEVLLVIEAYKTLRDRAPYPASFMLSQLTGSYAFVLFDKSTSSLLVASDPEGKVPLYWGITADGCVAFSDDIDLLKGSCGKSLAPFPQGCFYWNALGGLKSYENPKHKVTAVPADEEEICGATFMVEGSTVLTALQ

SEQ ID NO: 5670 - protein, 240 aa, Brachypodium distachyon
MLAVFSGEVVEVPAELVAAGSRTPSPKTRASELVKRFLAAPGADPAVSVDLGSLGNLAYSHANQSLLLPRSFAAKDEIFCLFEGVLDNLGRLSQQYGLSKGGNEVVLVIEAYKTLRDRAPYPASFMLSQLTGSYAFVLFDKSTSSLLVASDPEGKVPLFWGITADGCVAFSDDIDLLKGSCGKSLAPFPQGCFYWNALGGLKSYENPKNKVTAVPANEEEICGATFMVEGSSTVLTAPLQ

SEQ ID NO: 5671 - protein, 237 aa, Oryza sativa
MLAVFSGAVVEVPAELVAAGSRTPSPKTRASELVGRFLAAAEPAVSLQLGDLGHLAYSHANQSLLRPRSFASKDDIFCLFEGVLDNLGRLSQQYGLSKGANEVLLVIEAYKTLRDRAPYPASFMLSQLTGSYAFVLFDKSTSSLLVASDPEGKVPLFWGITADGSVAFSNDIDLLKGSCGKSLAPFPQGCFYSNALGGLKCYENPKNKVTAVPANEEEICGATFKVESATAILTALH

SEQ ID NO: 5672 - protein, 238 aa, Oryza sativa
MLGVFSGDVVEVPAELVAAGSRTPSPKTRASELVSRFLGGAEPAVSVQLGDLGHLAYSHANQALLRPRSFAAKDDIFCLFEGVLDNLGNLNQQYGLSKGANEVLLVIEAYKTLRDRAPYPASFMLSQLAGSYAFVLFDKSTSTLLVASDPEGKVSLYWGITADGSVAFSDNIDLLKGSCGKSLAPFPQGCFYSNALGVGGLKCYENPKHKVTAVPAKEEEICGATFKVEGSTILTALH

SEQ ID NO: 5673 - protein, 217 aa, Saccharum officinarum
RTPSPKTRASELVGRFLGASEPAACVQLGDLGHLAYSHTNQALLRPRSFAAKDEVFCLFEGVLDNLGRLSQQYGLSTKGANEVLLVIEAYKTLRDRAPYPASFMLAQLTGSYAFVLFDKSTNSLLVASDPEGKVPLFWGITADGCVAFSDDIDMLKGSCGKSLAPFPQGCFYSNALGGLKCYENPKHKVTAVPADEEEICGATFKVEGSTVLTALHY

SEQ ID NO: 5674 - protein, 215 aa, Saccharum officinarum
  misc_feature (208)..(208): Xaa can be any naturally occurring amino acid
MLAVFSGGVVEVPAELVAAGSRTPSPKTRASELVGRFLGASEPAVSVQLGDLGHLAYSHTNQALLRPRSFAAKDEVFCLFEGVLDNLGRLSQQYGLSTKGANEVLLVIEAYKTLRDRAPYPASFMLAQLTGSYAFVLFDKSTNSLLVASDPEGKVPLFLGITADGCVAFSDDIDMLKGSCGKSLAPFPQGCSTLTPLGGLSATRTPAXGHCCPCR

SEQ ID NO: 5675 - protein, 300 aa, Arabidopsis lyrata
MEVEFKALLDDLDVLEKSLSDPAPIHKLRSHVENLATLSKCNPHRRSKVKELSSEVVDNNPYSRLMALQRMGIVDNYERIREFSVAIVGIGGVGSVAAEMLTRCGIGRLLLYDYDTVELANMNRLFFRPDQVGMTKTDAAVQTLAEINPDVVLESFTMNITTVQGFETFTSSLTNKSFCPSKEGGSGVDLVLSCVDNYEARMAVNQACNELRQTWMESGVSEDAVSGHIQLLVPGETACFACAPPLWNMGEFKDFVIQGLSWHQELMNGHLSGKGSVLHLCQLLWVLLRVFWFKTLSSSY

SEQ ID NO: 5676 - protein, 925 aa, Arabidopsis thaliana
MGSCFSFQIAVGDQTMNRIFDCLIGKSYIRTLEQNLRALQREMEDLRATQHEVQNKVAREESRHQQRLEAVQVWLDRVNSIDIECKDLLSVSPVELQKLCLCGLCTKYVCSSYKYGKKVFLLLEEVKILKSEGNFDEVSQPPPRSEVEERPTQPTIGQEEMLEKAWNRLMEDGVGIMGLHGMGGVGKTTLFKKIHNKFAEIGGTFDIVIWIVVSQGAKLSKLQEDIAEKLHLCDDLWKNKNESDKATDIHRVLKGKRFVLMLDDIWEKVDLEAIGIPYPSEVNKCKVAFTTRSREVCGEMGDHKPMQVNCLEPEDAWELFKNKVGDNTLSSDPVIVGLAREVAQKCRGLPLALNVIGETMASKTMVQEWEYAIDVLTRSAAEFSGMENKILPILKYSYDSLGDEHIKSCFLYCALFPEDGQIYTETLIDKLICEGFIGEDQVIKRARNKGYAMLGTLTRANLLTKVGTELANLLTKVSIYHCVMHDVVREMALWIASDFGKQKENFVVQASAGLHEIPEVKDWGAVRRMSLMRNEIEEITCESKCSELTTLFLQSNQLKNLSGEFIRYMQKLVVLDLSDNRDFNELPEQISGLVSLQYLDLSFTRIEQLPVGLKELKKLTFLDLAYTARLCSISGISRLLSLRVLSLLGSKVHGDASVLKELQQLENLQDLAITLSAELISLDQRLAKVISILGIEGFLQKPFDLSFLASMENLSSLWVKNSYFSEIKCRESETDSSYLHINPKIPCFTNLSRLDIVKCHSMKDLTWILFAPNLVVLFIEDSREVGEIINKEKATNLTSITPFLKLERLILCYLPKLESIYWSPLPFPLLLNIDVEECPKLRKLPLNATSAPKVEEFRILMYPPELEWEDEDTKNRFLPEMVSTSTSSKDPLLRNGIPRCLKSESTLLLLILLYLSSCRAFGLYN

SEQ ID NO: 5677 - protein, 623 aa, Arabidopsis lyrata
SSLSFSQTYRDMDLLDSSSISKVRVVLRVRPFLPRDEGRSCVSVINSDDGEASEVTVHLKDPESCRNESYQLDAFYGRDDDNVKQIFDRELSPLIPGIFQGFNATVLAYGATGSGKTFTMQGIDELPGLMPLTMSYILSMCEKTGSRADISYYEVYMDRCWDLLEVKANEIAIWDDKNGQVHLKGLSSVPVNSMPEFHEAYSCGVQRRKVAHTGLNDVSSRSHGVLVISVTSQGDVTGKINLIDLAGNEDNRRTGSEGIRLQESAKINQSLFALSNVVYALNNNLPRVPYRESKLTRILQDSLGGTSRALMVACLNPGEYQESLRTVSLAARSRHISNNISLNPKVETPKVKIDMGAKLQAWLESKGKTKSVHRMMAIRSPLMGTNQTSISQSSVKKLGCQRSTIAESAKLDGKGERDAFVTARNLFGGETHAASHLWEPIQNLHLASPTKGDERDTSAKENLLVSEASLRDNSLGLEKEYTELSPFREALSPVDSNAPKSADASSPILKPMTPKTPFIYANAENMQMEGTYQKFNAWSTNLKTSLIKEYIHFLNTANRKELRELKGIGQKMAEYIIELRETSPLKSLTDLEKIGFTSRQVHNLFKKATEGILEKPVTASTTP

SEQ ID NO: 5678 - protein, 815 aa, Arabidopsis lyrata
MEDGEIEEGMVTTDEIPTPEVTTETTQPPQEPGKSPLELLRESKTSVEEIITKMLSMKKQGNQKSEIRELLTQMFLNFVNLRQANRAILTEEDKVKAETERAKAPVDFTTLQLHNLMYEKSHYVKAIKACRDFKSKYPDIDLVPEQDFFRHAPDAIKDQSLSSDSSHVLMPKRLNFELHQRKELCKQRARLEQQKKSLLDTIAERKKFLSSLPLHLKSLKKASLPVQNQLGIQHTKKLKQHNLAELLPPPLYVIYSQLLAQKEAFEESIELEVVGSLKDAQAYARQQSKKDSGMLNNTESSRLEDDGPDDDDDGQRRRKRPKKLTSKEGSDKAGLYQVHPLKIVLHIYDDEIPDTKSLKLVILKFEYVLKLNVVCVGAEGSQDGPEKNIFCNLFPDDAGLEPPHQSTKLILGDGQAFDENRTSRPYKWVQHLAGIDILPIILGEEAHNTDSAKSDTFVPDLSLYRQQHRVQTVLQRIRSRKKAHLALAEQLDLLMKHELPVVNCEDAPWALHKVLCALDSWLHIRSSDSKSCSLTLNSVEQVPEPMEIDVDGRSVSGKEDLESIREDGELPSLVTAAASLTSSNHTPSKVSNQARSRQLALMTKNLDSPISKGKSPSFKKYEDDLDLVLDDSEVDEPPTEAHVEALCPEKADNSWVDYGVREFALVLSRKIDGGKLWKLEATVCISMEYPLRPPLFSLSLHASSSSGNGNGTNESDHYNELRAMEAEVNLHMLKIIPSDQENYLLSHQIRCLAMLFDYYADDPSPDSKRGTATTVVDVGLCKPVDGKLLVRSFRGRDHRKMISWKGKGCASGYPC

SEQ ID NO: 5679 - protein, 581 aa, Brassica napus
MEDGEIEEGMVTADEYPTSEAAMETVATPREPVKSPLELLRESKTSVEEIVGRMLSIKKEGNNKSEIRELLTQMFLNFVNLRQANRAILTEEDKVKAETERAKGPVDFTTLQLHNLMYEKSHYVKAIKACRDFKSKYPDIDLVSEEAFFRDAPEDQSVATDTSRLLMPKRLNFELHQRKELCKHRARLEQKKKSLLETIAERKKFLSSLPLHLKSLKKASIPVQNQLGIQHTKKLKQHSLAELLPPPLYVIYSQLLAQKEAFQERIDLELLGSLKDAQAYARQQSNKDSGMSSNNTENSRLEDDGPDDDDDGQRRRKRPKKVTSKEGSDKAGLYQVHPLKIVLHVYDDETSDTKPLKLVVLKFEYFLKLNVVCVGAEGSPDAPEKNIFCNLFPDDAGLEPPHQSTKLILGDGQVFDENRTSRPYKWVQHLAGIDILPEVSPILFGQDTPDNIDTAKSDASVPDLSLYRQQHRVETVLQRIRSRKKAHLALAEQLDMLMKHELPAVNCEDAPWALHKVLCALDSWLQIRSSARKSCSLTLSSVEQVPEPMEIDGDRRSLSGKEDVKVFGKTENFLLWSQLQL

SEQ ID NO: 5680 - protein, 318 aa, Solanum phureja
MGAEVSKQVERRKAIDTQKKSLCDLKEKNGCNFPGYDYHVQDRKNWMSTLAPEKLHVNQIVWPGTHDSATDEIGIPFISRPFAQCQSLSIYQQLVTGVRVLDIRVQEDRRVCHGILLCYHVDVVINDVKKFLSETHSEIIILEIRTEFGHDDPPDFDKYLEAELGEFLIHQDDNVFNKTIAELLPKRIICIWKPGKSPQPRQGSPLWSSCYLKDNWIDTDLPEKKFESNMKYLSEQPPITSRKFFYRVENTVTPQADNPVLWVKPVTERIHPYARLFIMECISRGYGDRIQIFSSDFIDEDFVDACIGLTNARIEGKL

SEQ ID NO: 5681 - protein, 318 aa, Nicotiana tabacum
  misc_feature (72)..(72): Xaa can be any naturally occurring amino acid
  misc_feature (75)..(75): Xaa can be any naturally occurring amino acid
  misc_feature (136)..(136): Xaa can be any naturally occurring amino acid
  misc_feature (163)..(163): Xaa can be any naturally occurring amino acid
MGAEVSKQVERRKSIHTQKKILYDLKEKNGCNFPGCDYHVQDRKNWMSALIPEKLHVNKIVWPGTHDSATNXIGXPFISRPFAQCQSLSIYEQLVIGARVLDIRVQEDRRICHGILLSYNVDVVINDVKKFLSETXSEIIILEIRTEFGHDDPPDFDKYLEDXLGEFLIHQDDNVFNKTIAELLPKRIICVWKPRKSPQPKHGSPLWSSGYLKDNWIDTDLPETKFESNMKHLSEQPPVTSRKFFYRVENTVTPQADNPVLCVKPVTDRIHPYARLFVMECISRGYGDRLQIFSSDFIDEDFVDACIGLTNARIEGKF

SEQ ID NO: 5682 - protein, 632 aa, Solanum phureja
MASTPSPHTAATAHLNSLLSSSSSVNHNKPSNLSFLHASSNPSSIKLLHSVSPSISSSSSTTSICNVLKTVESADISLSRDLHGVVSTSKPTILVSEKLGEAGLDLLRSFGNVDCSYDLSPQDLCTKISLCDALIVRSGTKVTREVFEAAQGRLKVVGRAGVGIDNVDLQAATEFGCLVVNAPTANTIAAAEHGIALLTSMARNVAQSDASMKAGKWLRSKYVGVSLVGKTLAIMGFGKVGSEVARRAKGLGMHVIAHDPYAPADRARAIGVDLVSFEQAISTADFISLHMPLTPATNKVFNDDTFAKMKKGVRLINVARGGVIDEDALVRALDSGIVAQAALDVFTVEPPPKDSKLVQHENVTVTPHLGASTKEAQEGVAIEIAEAVVGALNGELSATAVNAPMVPPEVLSELAPYVVLAEKLGRLAVQLVTGGSGIQSVKVVYKSARDPDSLDTRLLRAMVTKGIIEPISDTIINLVNADFSAKQKGLRISEERIIVDSSPEYPVESIQVQISNVQSRFASALSENGNISIEGKVKYGVPHLTRVGPFSVDVSLEGNLILCKQVDQPGMIGKVGNILGESNVNVSFMSVGRTVKGKQAIMAIGVDEEPDKDTQKKIGEVSAVEEFVFLKL

SEQ ID NO: 5683 - protein, 421 aa, Nicotiana tabacum
  misc_feature (16)..(16): Xaa can be any naturally occurring amino acid
MKAGKWLRSKYVGVSXVGKTLAVMGFGKVGSEVARRAKGLGMHVIAHDPYAPADRARAIGVDLVSFEQAIATADFVSLHMPLTPATKKVFNDDAFAKMKKGVRLINVARGGVIDEDALVRALDSGIVAQAALDVFTVEPPPKDSKLVQHENVTVTPHLGASTKEAQEGVAIEIAEAVVGALNGELSATAVNAPMVPPEVLSELAPYVVLAEKLGRLAVQLVTGGSGIQNVKVVYKSARDPDSLDTRLLRAMVTKGIIEPISDTIINLVNADFSAKQKGLRISEERVIVDSSPEYPVESIQVQISNVQSRFASALSENGNISIEGKVKYGVPHLTRVGSFSVDVSLEGNLILCKQVDQPGMIGQVGNILGESNVNVSFMSVGRTVRRKQAIMAIGVDEEPNKDTQKKIGEVSAIEEFVFLKL

SEQ ID NO: 5684 - protein, 630 aa, Triphysaria pusilla
MAATSISATNKLTNQTPAFSPQKKSSNTSSAHLSFSHSSISLQKVSISADFKSLNPRASTVSNVLKTVQQSEQVSKSRDLDSVAGSTKPTVLVSEKLGEAGLDLLRSFGNVECLYNLSPEELCAKISECDALIVRSGTKVTRQVFEAAKGRLKVVGRAGVGIDNVDLQAATEFGCLVVNAPTANTIAAAEHGIALLAGMARNVAQADASIKAGKWLRNKYVGVSMVGKTLAVMGFGKVGSEVARRAKGLGMIVIAHDPYAPADRARALGVDLVSFDQAISTADFVSLHMPLTPTTNKVFNDATFAKMKKGVRIINVARGGVIDEDALVRALENGTVAQAALDVFSEEPPSKDSKLVQHENVTVTPHLGASTKEAQEGVAVEIAEAVVGALKGELSATAVNAPMVPPEILSELAPYVILAEKLGRLAVQLVAGGSGIQSVKVVYRSSRDPDSLDTRLLRAMITKGIIEPISDAHINLVNADFTAKQKGLRISEERVLIDSSPENPIQSIQVQISNVQSKFASALSENGNISIEGEVKYGIPHLTRVGPFSVDVSLEGNLILCRQVDQPGMIGRVGNILGESNVNVSFMSVGRVVKRTKALMAIGVDEEPDKDTLRKIGEVSAIEEFVFLDL

SEQ ID NO: 5685 - protein, 210 aa, Mimulus guttatus
MAATSISSAANKLTNQTPSFPPHEKNSHPSPTCLSFSNSSISLQKLSFSTNFTNPNSRSSTAINVLKTAEASESVSRTRDPEPVGKSTKPTILVSEKLGEAGLDLLRSFGNVECLYSLSQEDLCAKISECDALIVRSGTKVTRQVFEAAKGKLKVVGRAGVGIDNVDLQAATEFGCLVVNAPTANTIAAAEHGIALLAGMARNVAQLMLP

SEQ ID NO: 5686 - protein, 631 aa, Mimulus guttatus
MAATSISSAANKLTNQTPSFQPQEKNSHSSPTCLSFSNSSISLQKLSFSTNFTNPNSRSSTAINVLKTAEASESVSRTRDPEPVGKSTKPTILVSEKLGEAGLDLLRSFGNVECLYSLSQEDLCAKISECDALIVRSGTKVTRQVFEAAKGKLKVVGRAGVGIDNVDLQAATEFGCLVVNAPTANTIAAAEHGIALLAGMARNVAQADASMKAGKWQRNKYVGVSLVGKTLAVMGFGKVGSEVARRAKGLGMHVIAHDPYAPADRARALGAELVSFDQAISTADFISLHMPLTPATNKILNDDTFAKMKKGVRIINVARGGVIDEDALVRALDNGIVAQAALDVFTVEPPPQDSKLVQHENVTVTPHLGASTKEAQEGVAVEIAEAVVGALRGELSATAVNAPMVPPEVLSELAPYVALAEKLGRLAVQLVAGGSGIQSVKVAYSSARDPDNLDTRLLRAMITKGIIEPISDAHINLVNADFIAKQKGLRLSEERVFVDSSPENPIESIQVQISNVGSKFASALSDNGNISVEGKVKYGVPHLTRVGPFSVDVSLEGNLILCRQVDQPGMIGQVGSILGESNVNVSFMSVGRTLKRTKAVMAIGVDEEPDKETLKKIGEVAAIEEFVFLDL

SEQ ID NO: 5687 - protein, 136 aa, Solanum phureja
MASISGTMISTSFMPRKPIVTFPDLLGVKYANGGKITCMATYKVKLITPSGAVEFDCPDDVYILDQAEEEGHELPYSCRAGSCSSCAGKIVSGSVDQSDGNFLEDEQISSGYVLTCVAYPQSDVTIETHKEEQLTS

SEQ ID NO: 5688 - protein, 162 aa, Brassica napus
MTIALTIGGNGFSGLPGSSFSSASSSLRLKNSRRKNTKMLNRKGVVCSSSSVMDPYKTLRIRPDSSEYEVKQAFRQLAKKYHPDVCRGSNCGVQFQTINEAYDIVLKQIKNQMEGTEEFQPFDVYDEGFNGMNDPDCDTWEEWMGWEGAGTRDYSSHVNPYA

SEQ ID NO: 5689 - protein, 162 aa, Brassica rapa
MTIALTIGGNGFSGLPGSSFSSASSSLRFKNSRRKNTKMLNRKGVICSSSSVMDPYKTLRIRPDSSEYEVKQAFRQLAKKYHPDVCRGSNCGVQFQTINEAYDIVLKQIKNQMEGAEEFQPFDVYDEGFNGMNDPDCDTWEEWMGWEGAGTRDYSSHVNPYA

SEQ ID NO: 5690 - protein, 162 aa, Brassica napus
MTIALTIGGNGFSGLPGSSFSSASSSLRLKNSRRKNTKMLNRKGVVCSSSSVMDPYKTLRIRPDSSEYEVKQAFRQLAKKYHPDVCRGSNCGVQFQTINEAYDIVLKQIKNQMEGAEEFQPFDVYEEGFNGMNDPDCETWEEWMGWEGAGTRDYSSHVNPYA

SEQ ID NO: 5691 - protein, 162 aa, Raphanus sativus
MTIALTIGGSGFSGLPGSSFSSSSSSLRLKNSRRKDTKMLNRKGVICSSSSVMDPYKTLRIRPDSSEYEVKQAFRQLAKKYHPDVCRGSNCGVQFQTINEAYDIVLKQIKNQMEGTEEFQPFDVYEEGFNGMNDPDCDTWEEWMGWEGAGTRDYSSHVNPYA

SEQ ID NO: 5692 - protein, 163 aa, Unknown
  Sequence found in Organisms: Arabidopsis thaliana, Arabidopsis lyrata
MTIALTIGGNGFSGLPGSSFSSSSSSFRLKNSRRKNTKMLNRSKVVCSSSSSVMDPYKTLKIRPDSSEYEVKKAFRQLAKKYHPDVCRGSNCGVQFQTINEAYDIVLKQIKNQMEGTEEFEPFDVYDEGLNGMNDPDCDTWEEWMGWEGAGTRDYSSHVNPYA

SEQ ID NO: 5693 - protein, 209 aa, Arabidopsis lyrata
RPLQQDKWSKGKDGFLVTDIWGIDATPTILIQKTQERFYFLTYQYKSLTLVLLVPTAAIVNGELDISFVKQQVIENASAKILKVEEKLSKGWGGENAYHVSGYRYLLVDNDMEVSRASPAGKVATLAKESLLALNKLREEVDTEKSRSKQEKDMETCIRAKNNTWVIARLNRGKELYMALEKASETLLDATDSVQRFSNRYCSGAFSMD

SEQ ID NO: 5694 - protein, 151 aa, Raphanus sativus
  misc_feature (103)..(103): Xaa can be any naturally occurring amino acid
MTIALTIGGNVFSGLSVSNNIRRKNKKMINRTGVVCSSSSVMDPYKTLKIRPDSSEYEVKQAFRQLAKKYHPDVCRGSNCGVQFQTINEAYDIVLKQIKNQMXGTEEYEPFDVYDDGFNGMNDPDCDTWEEWMGWEGAGTRDYSSHVNPYA

SEQ ID NO: 5695 - protein, 152 aa, Raphanus sativus
MTIALTIGGNVFSGQSVSKNNIRRNNKKMLNRTGVVCSSSSVMDPYKTLKIRPDSSEYEVKQAFRQLAKKYHPDVCRGSNCGLQFQTINEAYDIVLKQIKNQMDGTEEYEPFDVYEDGFNGMNDTDCDTWEEWMGWEGAGTREYSSHVNPYA

SEQ ID NO: 5696 - protein, 378 aa, Brassica napus
MAKMMMLQQSQPSLSLLTSSLSDFNGAKLHSQVQYKRKVQQPKGALYVSASSEKKILIMGGTRFIGIFLSRLLVKEGHQVTLFTRGKSPIAKQLPGESDQDFADFSSKILHLKGDRKDYDFVKSSLSAEGFDVVYDINGREAEEVEPILDALPKLEQYIYCSSAGVYLKSDVLPHCEVDAVDPKSRHKGKLETESLLQSKGVNWTSIRPVYIYGPLNYNPVEEWFFHRLKAGRPIPVPNSGIQISQLGHVKDLATAFLAVLGNEKASREIFNISGEKYVTFDGLARACAKAGGFPEPEIVHYNPKEFDFGKKKAFPFRDQHFFASVEKAKHVLGWKPEFDLVEGLTDSYNLDFGRGTFRKEADFTTDDMILSKKLVLQ

SEQ ID NO: 5697 - protein, 378 aa, Raphanus sativus
MAKMMMMQQSQPSLSLLTSSLSDFNGAKLNLQVQYKRKVQQPKGALYVSASSEKKILIMGGTRFIGIFLSRLLVKEGHQVTLFTRGKSPIAKQLPGESDQDFADFSSKILHLKGDRKDYDFVKSSLSAEGFDVVYDINGREAEEVEPIIEALPKLEQYIYCSSAGVYLKSDVLPHCEVDAVDPKSRHKGKLETESLLQSKGVNWTSIRPVYIYGPLNYNPVEEWFFHRLKAGRPIPVPNSGIQISQLGHVKDLATAFLAVLGNEKASREIFNISGEKYVTFDGLARACAKAGGFPEPEIVHYNPKEFDFGKKKAFPFRDQHFFASVEKAKHVLGWKPEFDLVDGLTDSYNLDFGRGTFRKEADFTTDDMILSKKLVLQ

SEQ ID NO: 5698 - protein, 378 aa, Raphanus sativus
MAKMMMMQQSQPSLSLLTSSLSDFNGAKLNLQVQYKRKVQQPKGALYVSASSEKKILIMGGTRFIGIFLSRLLVKEGHQVTLFTRGKSPIAKQLPGESDQDFADFSSKILHLKGDRKDYDFVKSSLSAEGFDVVYDINGREAEEVEPILDALPKLEQYIYCSSAGVYLKSDILPHCEVDAVDPKSRHKGKLETESLLQSKGVNWTSIRPVYIYGPLNYNPVEEWFFHRLKAGRPIPVPNSGIQISQLGHVKDLATAFLAVLGNEKASREIFNISGEKYVTFDGLAKACAKAGGFPEPEIVHYNPKEFDFGKKKAFPFRDQHFFASVEKAKHVLGWKPEFDLVDGLTDSYNLDFGRGTFRKEADFTTDDMILSKKLVLQ

SEQ ID NO: 5699 - protein, 379 aa, Brassica juncea
MAKMMMMQQSQPSLSLLTSSLSDFNGAKLHLQVQYKRKVQQPKGALYVSASSEKKILIMGGTRFIGIFLSRLLVKEGHQVTLFTRGKSPIAKQLPGESDQDFADFSSKILHLKGDRKDYDFVKSSLSAEGFDVVYDINGREAEEVEPILDALPKLEQYIYCSSAGVYLKSDVLPHCEVDAVDPKSRHKGKLETESLLQSKGVNWTSIRPVYIYGPLNYNPVEEWFFHRLKAGRPIPVPNSGIQVSQLGHVKDLATAFLAVLGNEKASKEIFNISGDKYVTFDGLARACAKAGGFPEPEIVHYNPKEFDFGKKKAFPFRDQHFFASVEKAKHVLGWKPEFDLVEGLTDSYNLDFGRGTFRKEADFTTDDMILSKKLVLQS

SEQ ID NO: 5700 - protein, 375 aa, Brassica oleracea
MAKMMMLQQSQPSLSLLTSSLSDFNGAKLHSQVQYKRKVQQPKGALYVSASSEKKILIMGGTRFIGIFLSRLLVKEGHQVTLFTRGKSPIAKQLPGESDQDFADFSSKILHLKGDRKDYDFVKSSLSAEGFDVVYDINGREAEEVEPILDALPKLEQYIYCSSAGVYLKSDVLPHCEVDAVDPKSRHKGKLETESLLQSKGVNWTSIRPVYIYGPLNYNPVEEWFFHRLKAGRPIPVPNSGIQISQLGHVKDLATAFLAVLGNEKASREIFNISGEKYVTFDGLARACAKAGGFPEPEIVHYNPKEFDFGKKKAFPFRDQHFFASVEKAKHVLGWKPEFDLVEGLTDSYNLDFGRGTFRKEADFTTDDMILSKKL

SEQ ID NO: 5701 - protein, 378 aa, Arabidopsis thaliana
MAKMMMLQQHQPSFSLLTSSLSDFNGAKLHLQVQYKRKVHQPKGALYVSASSEKKILIMGGTRFIGLFLSRILVKEGHQVTLFTRGKSPIAKQLPGESDQDFADFSSKILHLKGDRKDYDFVKSSLSAEGFDVVYDINGREAEEVEPILEALPKLEQYIYCSSAGVYLKSDILPHCEEDAVDPKSRHKGKLETESLLQSKGVNWTSIRPVYIYGPLNYNPVEEWFFHRLKAGRPIPVPNSGIQISQLGHVKDLATAFLNVLGNEKASREIFNISGEKYVTFDGLAKACAKAGGFPEPEIVHYNPKEFDFGKKKAFPFRDQHFFASVEKAKHVLGWKPEFDLVEGLTDSYNLDFGRGTFRKEADFTTDDMILSKKLVLQ

SEQ ID NO: 5702 - protein, 378 aa, Arabidopsis lyrata
MAKMMMLQQHQPSFSLLTSSLSDFNGAKLHLQVQYKRKVHQPKGALHVSASSEKKILIMGGTRFIGVFLSRLLVKGGHQVTLFTRGKSPIAKQLPGESDQDFADFSSKILHLKGDRKDYDFVKSSLSAEGFDVVYDINGREAEEVEPIIDALPKLEQYIYCSSAGVYLKSDILPHCEEDAVDPKSRHKGKLETESLLQSKGVNWTSIRPVYIYGPLNYNPVEEWFFHRLKAGRPIPVPNSGIQISQLGHVKDLGTAFLNVLGNEKASREIFNISGEKYVTFDGLAKACAKAGGFPEPEIVHYNPKEFDFGKKKAFPFRDQHFFASVEKAKHVLGWKPEFDLVEGLTDSYNLDFGRGTFRKEADFTTDDMVLSKKLVLQ

SEQ ID NO: 5703 - protein, 379 aa, Cleome gynandra
MAKMVVLQHQQPSFSCLSSSLSDFNGAKLNFQVQYKRKKVYQPKGALHVSASSAKKILIMGGTRFIGVFLSRLLVKDGHQVTLFTRGKAPIAKQLPGESEEDFADFSSKILHLKGDRKDYDFVKSSLAAEGFDVVYDINGREAEEVAPIVDALPKLEQYIYCSSAGVYLKSDLLPHCEIDAVDPKSRHKGKLETESLLESRGVNWTSIRPVYIYGPLNYNPVEEWFFHRLKAGRPIPVPNSGIQITQLGHVKDLATAFQIVLGNEKASREVFNISGDRYVTFDGLARACAKAGGFPEPEIVHYNPKEFDFGKKKAFPFRDQHFFASVEKAKHVLGWKPEFDLVEGLTDSYNLDFGRGTYRKEADFTTDDMILNKKLVLQ

SEQ ID NO: 5704 - protein, 379 aa, Cleome spinosa
MAKMVVLQQHQPSFSPLSSSLSDFNGTKLNFRVQYKRKAYRPKGALHVSASSAKKILIMGGTRFIGVFLSRLLVKDGHQVTLFTRGKAPIAKQLPGESDEDFADFSSKILHLKGDRKDYDFVKSSLAAEGFDVVYDINGREAEEVAPILDALPTLEQFIYCSSAGVYLKSDLLPHCETDAVDPKSRHKGKLETESLLESRGVNWTSIRPVYIYGPLNYNPVEEWFFHRLKAGRPIPVPSSGIQITQLGHVKDLATAFQIVLGNEKASREVFNISGEKYVTFDGLARACAKAGGFPEPEIVHYNPKEFDFGKKKAFPFRDQHFFASVEKAKHVLGWKPEFDLVEGLTDSYDLDFGRGTFRKEADFTTDDMILGKNLVLQS

SEQ ID NO: 5705 - protein, 379 aa, Cleome spinosa
MAKMVVLQQHQPSFSPLSASLSDFNGAKLNLRVQYKRKAYKPKGALHVSASSAKKILIMGGTRFIGVFLSRLLMKDGHQVTLFTRGKVPIAKQLPGESDEDFADFSSKILHLKGDRKDYDFVKSSLAAEGFDVVYDINGREAEEVAPLLDALPKLEQYIYCSSAGVYLKSDLLPHCETDAVDPKSRHKGKLETESLLESRNVNWTSIRPVYIYGPLNYNPVEEWFFHRLKAGRPIPVPNSGIQITQLGHVKDLATAFQIVLGNEKASREVFNIAGEKYVTFDGLARACAKAGGFPEPEIVHYNPKEFDFGKKKSFPFRDQHFFASVEKAKHVLGWKPEFDLVEGLTDSYNLDFGRGTYRKDPDFTTDDMILGKKLVLQS

SEQ ID NO: 5706 - protein, 379 aa, Unknown
  Sequence found in Organisms: Castanea mollissima, Quercus alba
MAKLVVVQQKQPSFSLLPSSLSDFNGTRLQSQIQLKRKVWKPKGALHVSASSAKKILIMGGTRFIGVFLSRLLVKEGHQVTLFTRGKAPITQQLPGESDKDFVDFSSKILHLKGDRKDYEFVKSSLSAEGFDVVYDINGREAEEVEPILDALPKLEQYIYCSSAGVYLKSDLLPHFETDAVDPKSRHKGKLETESLLTSKGVNWTSIRPVYIYGPLNYNPVEEWFFHRLKAGRPIPIPNSGVQITQLGHVKDLARAFIQVLGNEKASRQVFNISGDKYVTFDGLARACAKAGGFPEPEIIHFNPKEFDFGKKKAFPFRDQHFFASIDKAKSVLGWKPEFDLVEGLADSYNLDFGRGTFRKAADFSTDDLILGKSLVLQS

SEQ ID NO: 5707 - protein, 380 aa, Aquilegia formosa
MARVMVVQQKQLAFSLPPSSLSDFHGIRLNQPIQYKRKEWHKPKGALQVTASSAKKILIMGGTRFIGVFLSRLLVKEGHQVTLFTRGKAPITQQLPGESDTDFSDFSSKILHLKGDRKDYDFVKSSLAAEGFDVVYDINGREAEEVEPILDALPNLEQYIYCSSAGVYLKSDLLPHFEIDAVDPKSRHKGKLETESLLQSKDVNWTSIRPVYIYGPLNYNPVEEWFFHRLKAGRPIPVPNSGVQITQLGHVKDLATAFIQVLGNEKASKQIFNISGEKYVTFDGLARACAKAGGFPEPEIIHYNPKEFDFGKKKAFPFRDQHFFASVDKAKSVLGWKPEFDLVEGLTDSYNLDFGRGTFRKEADFTTDDMIIGKSLVLQS

SEQ ID NO: 5708 - protein, 333 aa, Brassica juncea
YVSASSEKKILIMGGTRFIGIFLSRLLVKEGHQVTLFTRGKSPIAKQLPGESDQDFADFSSKILHLKGDRKDYDFVKSSLSAEGFDVVYDINGREAEEVEPILDALPKLEQYIYCSSAGVYLKSDVLPHCEVDAVDPKSRHKGKLETESLLQSKGVNWTSIRPVYIYGPLNYNPVEEWFFHRLKAGRPIPVPNSGIQVSQLGHVKDLATAFLAVLGNEKASKEIFNISGDKYVTFDGLARACAKAGGFPEPEIVHYNPKEFDFGKKKAFPFRDQHFFASVEKAKHVLGWKPEFDLVEGLTDSYNLDFGRGTFRKEADFTTDDMILSKKLVLQS

SEQ ID NO: 5709 - protein, 380 aa, Manihot esculenta
MASLVAIQQQAQPSFSILPSSLSDFNGTRLHTQLQCKRKVWQTRGALQVTASSSKNILVMGGTRFIGVFLSRLLVKEGHQVTLFTRGKAPITQQLPGESDQDFADFSSKILHLKGDRKDFDFVKSSLSAKGFDVVYDINGREADEVAPILDALPKLEQYIYCSSAGVYLKSDLLPHCETDAVDPKSRHKGKLETESLLESRDVNWTSIRPVYIYGPLNYNPVEEWFFHRLKAGRPIPIPNSGIQISQLGHVKDLATAFLQVLGNEKAYKEVFNISGEKYVTFDGLARACAKAAGFPEPEIIHYNPKEFDFGKKKAFPFRDQHFFASVDKAKHVLGWKPEFDLVEGLADSYNLDFGRGTYRKEADFSTDDLILGKSLVLQA

SEQ ID NO: 5710 - protein, 380 aa, Citrus sinensis
MASMVVVQHQTQPSFSTLTSSLSDFNGTRIHSQIQYRRKVLQPKVGLQITASSEKNILIMGGTRFIGVFLSRLLVKEGHQVTLFTRGKAPIAQQLPGESDQEFAEFSSKILHLKGDRKDYDFVKSSLSAKGFDVVYDINGREADEVEPILDALPNLEQFIYCSSAGVYLKSDLLPHCETDAVDPKSRHKGKLNTESVLESKGVNWTSLRPVYIYGPLNYNPVEEWFFHRLKAGRPIPIPGSGIQVTQLGHVKDLARAFVQVLGNEKASRQVFNISGEKYVTFDGLARACAKAAGFPEPELVHYNPKEFDFGKKKAFPFRDQHFFASVEKAKHVLGWKPEFDLVEGLADSYNLDFGRGTYRKEADFSTDDMILGKKLVLQA

SEQ ID NO: 5711 - protein, 380 aa, Manihot esculenta
MASLVAIQQQAQPSFSILPSSLSDFNGTRLHTQLQCKRKVWQTRGALQVTASSSKNILVMGGTRFIGVFLSRLLVKEGHQVTLFTRGKAPITQQLPGESDQDFADFSSKVLHLKGDRKDFDFVKSSLSAKGFDVVYDINGREADEVAPILDALPNLEQFIYCSSAGVYLKSDLLPHSEKDAVDPKSRHKGKLETESLLESSGVNWTSIRPVYIYGPLNYNPVEEWFFHRLKAGRPIPIPNSGIQITQLGHVKDLAKAFIQVLGNEKASKQVFNISGEKYVTFDGLARACAKAGGFPEPEIVHYNPKEFDFGKKKAFPFRDQHFFASVDKAKHVLGWEPEFDLVEGLADSYNLDFGRGTFRKEADFTTDDMILGKSLVLQS

SEQ ID NO: 5712 - protein, 381 aa, Ricinus communis
MARLITIQQQTQPSFSLLTSSLSSDFNGTRLHTQIQCKRRVWQAKGALQVTASSSKNILIMGGTRFIGVFLSRLLVKEGHQVTLFTRGKAPITQKLPGESDQDYADFSSKVLHLKGDRKDFDFVKSSLSAKGFDVVYDINGREADEVAPILDALPNLEQFIYCSSAGVYLKSDLLPHSEKDAVDPKSRHKGKLETESLLESSGVNWTSIRPVYIYGPLNYNPVEEWFFHRLKAGRPIPIPNSGIQITQLGHVKDLAKAFIQVLGNEKASKQVFNISGEKYVTFDGLARACAKAGGFPEPEIVHYNPKEFDFGKKKAFPFRDQHFFASVDKAKHVLGWEPEFDLVEGLADSYNLDFGRGTFRKEADFTTDDMILGKSLVLQS

SEQ ID NO: 5713 - protein, 327 aa, Raphanus sativus
SEKKILIMGGTRFIGIFLSRFLVKEGHQVTLFTRGKSPIAKQLPGESDQDFADFSSKILHLKGDRKDYDFVKSSLSAEGFDVVYDINGREAEEVEPILDALPKLEQYIYCSSAGVYLKSDILPHCEVDAVDPKSRHKGKLETESLLQSKGVNWTSIRPVYIYGPLNYNPVEEWFFHRLKAGRPIPVPNSGIQISQLGHVKDLATAFLAVLGNEKASREIFNISGEKYVTFDGLARACAKAGGFPEPEIVHYNPKEFDFGKKKAFPFRDQHFFASVEKAKHVLGWTPEFDLVDGLTDSYNLDFGRGTFRKEADFTTDDMILSKKLVLQ

SEQ ID NO: 5714 - protein, 380 aa, Cucumis melo
MANPMAAHHQKFTSFSVLPSSLSDFNGARLHAQVQYKRKVMQPKGGLHVTASAKKNILIMGGTRFIGIFLSRLLVKEGHQVTLFTRGKAPVTQQLPGESEADYADFKSKILHLKGDRKDFDFVKSSLSAAGFDVVYDINGREAVEVEPILDALPKLEQFIYCSSAGVYLKSDLLPHFEVDAVDPKSRHKGKLETESLLASKDVNWTSIRPVYIYGPLNYNPVEEWFFHRLKAGRPIPIPNSGIQITQLGHVKDLATAFVQVLGNDKASQQVFNISGEKYVTFDGLAKACAKAGGFPEPEIVHYNPKEFDFGKKKPFPFRDQHFFASVEKAKSVLGWKPEFDLVEGLADSYNLDFGRGTFRKEADFSTDDIILGKSLVLQA

SEQ ID NO: 5715 - protein, 275 aa, Antirrhinum majus
MASMVVMQHRQPSTAVLSSSLSDFNGAKLTSSVQYKKKLWKPKGALCVTASSTKKILIMGGTRFIGLFLSRLLVKEGHQVTLFTRGKAPIAQQLPGESETDFTDFSSKILHLKGDRKDYDFVKSSLSAEGFDVVYDINGREAEEVEPILDALPNLEQYIYCSSAGVYLKTDFPPHYESDAVDPKSRHKGKLETESLLASRDVNWTSIRPVYIYGPLNYNPVEEWFFHRLKAGRPIPIPNSGIQITQLGHVKDLATAFVTVLGNEKKQRGIQYSWR

SEQ ID NO: 5716 - protein, 381 aa, Ipomoea nil
MVSLVAVVQQPKSLSLSALPSSRSDFNGTKLAVSSVQYKRKVWQPKGALQISASAKKILIMGGTRFIGIFLSRLLVKEGHQVTLFTRGKAPIAQQLPGESDSDFADFSSKILHLKGDRMDFDFVKSSLAAEGFDVVYDINGREAVEVEPILDALPKLEQYIYCSSAGVYLKTDYLPHYEVDAVDPKSRHKGKLETESLLTSRGVNWTSIRPVYIYGPLNYNPVEEWFFHRLKAGRPIPVPNSGMQVTQLGHVKDLATAFIKVLGNEKASKQVFNISGDKYVTFDGLAKACAKAGGFPEPEIVHYNPKEFDFGKKKAFPFRDQHFFASIEKAKSVLGWKPEFDLVEGLTDSYSLDFGRGTFRKAADFSTDDLILGKSLVLQS

SEQ ID NO: 5717 - protein, 380 aa, Cucumis melo
MANPMAAHHQKFTSFSVLPSSLSDFNGARLHAQVQYKRKVMQPKGGLHVTASAKKNILIMGGTRFIGIFLSRLLVKEGHQVTLFTRGKAPVTQQLPGESEADYADFKSKILHLKGDRKDFDFVKSSLSAAGFDAVYDINGREAVEVEPILDALPKLEQFIYCSSAGVYLKSDLLPHFEVDAVDPKSRHKGKLETESLLASKDVNWTSIRPVYIYGPLNYNPVEEWFFHRLKAGRPIPIPNSGIQITQLGHVKDLATAFVQVLGNDKASQQVFNISGEKYVTFDGLAKACAKAGGFPEPEIVHYNPKEFDFGKKKPFPFRDQHFFASVEKAKSVLGWKPEFDLVEGLADSYNLDFGRGTFRKEADFSTDDIILGKSLVLQA

SEQ ID NO: 5718 - protein, 292 aa, Juglans hindsii x Juglans regia
MAKLVVLQQKQPSFSLLPASLSDFNGTRLHTQIQLKRKVWKPKGALRISASSTKKILIMGGTRFIGLFLSRLLVKEGHQVTLFTRGKAPITQQLPGESEKDYTDFSSKILHLKGDRKDFEFVKASLSAEGFDVVYDINGREAVEVEPILDALPKLEQYIYCSSAGVYLKSDLLPHFETDAVDPKSRHKGKLETESLLESKGVNWTSIRPVYIYGPLNYNPVEEWFFHRLKAGRPIPVPNSGMQITQLGHVKDLARVFVQVLGNEKASKEVFNISGEKYVTFDGSARACAKAA

SEQ ID NO: 5719 - protein, 383 aa, Prunus persica
MARLVAVQPQQRHPSFSLLPPSSLSDFNGTRLLHSQLQCKRRVSQPKVALQVTASSAKKILIMGGTRFIGLFLSRLLVKEGHQVTLFTRGKAPITQQLPGESDKDYTDFASKILHLKGDRKDYEFVKSSLSAEGFDVVYDINGREAEEVVPILEGLPKLEQYIYCSSAGVYLKSDQLPHFETDTVDPKSRHKGKLETESLLESKGVNWTSIRPVYIYGPLNYNPVEEWFFHRLKAGRPIPVPNSGIQITQLGHVKDLATAFIKVLGNEKASKEVFNISGEKYVTFDGLAKACAKAGGFPEPEIVHYNPKEFDFGKKKAFPFRDQHFFASIDKAKSVLGWKPEFDLVEGLADSYNLDFGRGTFRKEADFSTDDIILGKSLVLQS

SEQ ID NO: 5720 - protein, 379 aa, Gossypium hirsutum
MSKLVVLQPTKQPPISLLSSSLSHFNGTKLCQIQYKRKVYQPKGALHIAASSTKKILIMGGTRFIGVFLSRLLVKEGHQVTLFTRGKAPVTQQLPGESDSDYAEFKSKILHLKGDRMDFDFVKSSLSAEGYDVVYDINGREAAEVEPILDALPNLEQFIYCSSAGVYLKSDMLPHCETDAVDPKSRHKGKLNTESLLESRDVNWTSVRPVYIYGPLNYNPVEEWFFHRLKAGRPIPIPNSGVQITQLGHVKDLATAFIAVLGNEKASKQVFNISGEKYVTFDGLAKACAKAGGFPEPEIVHYNPKEFDFGKKKAFPFRDQHFFASVEKAKHVLGWKPEFDLVEGLTDSYNLDFGRGTFRKEADFSTDDMILGKSFVLQS

SEQ ID NO: 5721 - protein, 379 aa, Mimulus guttatus
MATMVVVHHKQPSSAILSSSLSDFSGARLTASVQYKRKVWQSKSALSVTASSEKKILIMGGTRFIGLFLSRLLVKEGHKVTLFTRGKAPIAQQLPGESDTEFSDYASKILHLKGDRKDFEFVKSSLSAEGFDVVYDINGREADEVEPILDALPNLEQYIYCSSAGVYLKTDCPPHYEVDAVDPKSRHKGKLETESLLQSRDVNWTSIRPVYIYGPLNYNPVEEWFFHRLKAGRPIPIPNSGIQITQLGHVKDLATAFIKVLGNEKASKEIFNISGEKYVTFDGLAKACAKAGGFPEPEIIHYNPKEFDFGKKKPFPFRDQHFFASVDKAKSVLGLKPEFDLVEGLTDSYNLDFGRGTFRKEADFSTDDIILGKSLVLQS

SEQ ID NO: 5722 - protein, 380 aa, Carica papaya
MATLVVLQQPKQPSFSFLHSSLSDFSGTKLHTQVQCKRRVYQPKGLLHVTASSAKKILVMGGTRFIGVFLSRLLVKEGHQVTLFTRGKAPITTQLPGESDQDYTDFSSKILHLKGDRKDFEFVKSSLSAEGFDVVYDINGREADEVEPILDALPKLEQYIYCSSAGVYLKSDLLPHFETDAVDPKSRHKGKLETESLLESKGVNWTSLRPVYIYGPLNYNPVEEWFFHRLKAGRPIPIPNSGMQTTQLGHVKDLAKAFLMVLGNEKACKQVFNISGEKYVTFDGLARACAKAAGFPEPEIVHYNPKEFDFGKKKAFPFRDQHFFASIDKAKHVLGWEPEFDLVEGLADSYNLDFGRGTYRKEADFSTDDMILGKKFALQS

SEQ ID NO: 5723 - protein, 383 aa, Prunus persica
  misc_feature (101)..(101): Xaa can be any naturally occurring amino acid
  misc_feature (330)..(330): Xaa can be any naturally occurring amino acid
  misc_feature (339)..(339): Xaa can be any naturally occurring amino acid
MARLVAVQPQQRHPSFSLLPPSSLSDFNGTRLLHSQLQCKRRVSQPKVALQVTASSAKKILIMGGTRFIGLFLSRLLVKEGHQVTLFTRGKAPITQQLPGXSDKDYTDFASKILHLKGDRKDYEFVKSSLSAEGFDVVYDINGREAEEVVPILEGLPKLEQYIYCSSAGVYLKSDQLPHFETDAVDPKSRHKGKLETESLLESKGVNWTSIRPVYIYGPLNYNPVEEWFFHRLKAGRPIPVPNSGIQITQLGHVKDLATAFIKVLGNEKASKEVFNISGEKYVTFDGLAKACAKAGGFPEPEIVHYNPKEFDFGKKKAFPFRDQHFFASXDKAKSVLGXKPEFDLVEGLADSYNLDFGRGTFRKEADFSTDDIILGKSLVLQS

SEQ ID NO: 5724 - protein, 378 aa, Nicotiana tabacum
MASLVAVQHKQPSFAVLPSSHSDFNGAKLISSLQFKRKPCQPKGALHVTASSAKKILIMGGTRFIGVFLSRLLVKEGHQVTLFTRGKAPISQQLPGESDQDYADFSSKLLHLKGDRMDFDFVKSSLSAEGFDVVYDINGREAVEVEPILDALPNLEQYIYCSSAGVYLKTDYLPHFEADAVDPKSRHKGKLETESLLESRDVNWTSVRPVYIYGPLNYNPVEEWFFHRLKAGRPIPIPNSGLQITQLGHVKDLATAFIQVLGNEKASKQVFNISGEKYVTFDGLAKACAKAGGFPEPEIVHYNPKEFDFGKKKAFPFRDQHFFASVEKAKAVLGWKPEFDLVEGLTDSYNLDFGRGTYRKEADFSTDDLILGKSLVLN

SEQ ID NO: 5725 - protein, 379 aa, Gossypium hirsutum
MSKLVVLQPTKQPPISLLSSSLSHFNGTKLCQIQYKRKVYQPKGALHIAASSTKKILIMGGTRFIGVFLSRLLVKEGHQVTLFTRGKAPVTQQLPGESDSDYAEFKSKILHLKGDRMDFDFVKSSLSAEGYDVVYDINGREAAEVEPILDALPNLEQFIYCSSAGVYLKSDMLPHCETDAVDPKSRHKGKLNTESLLESRDVNWTSVRPVYIYGPLNYNPVEEWFFHRLKAGRPIPIPNSGVQITQLGHVKDLATAFIAVLGNEKASKQVFNISGEKYVTFNGLAKACAKAGGFPEPEIVHYNPKEFDFGKKKAFPFRDQHFFASVEKAKHVLGWKPEFDLVEGLTDSYNLDFGRGTFRKEADFSTDDMILGKSFVLQS

SEQ ID NO: 5726 - protein, 380 aa, Cucumis sativus
MANPMAAHHQKFTSFSVLPSSLSDFNGARLHAQVQYKRKVMQPKGGLHVTASAKKNILIMGGTRFIGIFLSRLLVKEGHQVTLFTRGKAPVTQQLPGESEADYADFKSKILHLKGDRKDFDFVKSSLSAAGFDVVYDINGREADEVEPIIDALPKLEQFIYCSSAGVYLKSDLLPHFEVDAVDPKSRHKGKLETESLLASKDVNWTSIRPVYIYGPLNYNPVEEWFFHRLKAGRPIPIPNSGIQITQLGHVKDLANAFVQVLGNDKASQQVFNISGEKYVSFDGLAKACAKAGGFPEPEIVHYNPKEFDFGKKKPFPFRDQHFFASIEKAKSVLGWKPEFDLVEGLADSYNLDFGRGTFRKEADFSTDDIILGKSLVLQA

SEQ ID NO: 5727 - protein, 380 aa, Triphysaria pusilla
MASMVVVQHRQPSSTILSSSLSDFNGARLTASLQYKRKSWQPKSAALRVTASSSKKILIMGGTRFIGLFLSRLLVKEGHQVTLFTRGKAPIAQQLPGEPDSEFSDFSSKILHLKGDRKDFEFVKSSLSAEGFDVVYDINGREAVEVEPILDALPNLEQYIYCSSAGVYLKTDYPPHFEIDAVDPKSRHKGKLETESLLASRDVNWTSIRPVYIYGPLNYNPVEEWFFHRLKAGRPIPIPNSGIQVTQLGHVKDLATAFIKVLGNEKASKEVFNISGEKYVTFDGLARACAKAGGFPEPEIIHYNPKEFDFGKKKAFPFRDQHFFASVEKAKSVLGLKPDYDLVEGLTDSYNLDFGRGTFRKEADFSTDDIILGKSLVLQS

SEQ ID NO: 5728 - protein, 378 aa, Vigna unguiculata
MARMVALQQNQLSFSPLASSLSDFSGTRLHTQLQFKRKSWQPKGSFYVSASSTKKILIMGGTRFIGVFLSRLLVKEGHQVTLFTRGKAPVTQQLPGESDGDYADFSSKILHLKGDRKDFEFVKSSLSAVGYDVVYDINGREADEVEPILDALPNLEQFIYCSSAGVYLKSDLLPHAETDAVDPKSRHKGKLETESLLQSKGVNWTSIRPVYIYGPLNYNPVEEWFFHRLKAGRPIPIPSSGIQITQLGHVKDLATAFVKVLGNDKASKEVFNISGEKYVTFDGLARACAKAGGFPEPEIVHYNPKDYDFGKKKSFPFRDQHFFASVDKAKSVLGWEPEFDLVEGLADSYNLDFGRGTFRKEADFSTDDIILGKSLVGV

SEQ ID NO: 5729 - protein, 364 aa, Quercus alba
MAKLVVVQQKQPSFSLLPSSLSDFNGTRLQSQIQLKRKVWKPKGALHVSASSAKKILIMGGTRFIGVFLSRLLVKEGHQVTLFTRGKAPITQQLPGESDKDFVDFSSKILHLKGDRKDYEFVKSSLSAEGFDVVYDINGREAEEVEPILDALPKLEQYIYCSSAGVYLKSDLLPHFETDAVDPKSRHKGKLETESLLTSKGVNWTSIRPVYIYGPLNYNPVEEWFFHRLKAGRPIPIPNSGVQITQLGHVKDLARAFIQVLGNEKASRQVFNISGDKYVTFDGLARACAKAGGFPEPEIIHFNPKEFDFGKKKAFPFRDQHFFASIDKAKSVLGWKPEFDLVEGLADSYNLDFGRGTFRKAADF

SEQ ID NO: 5730 - protein, 379 aa, Salvia sclarea
MASMVVVQHRQPSSAVLSSSLSDFNGARLTSSLQLKRRVWQPKAALRVSASSAKKILIMGGTRFIGIFLSRLLVKEGHQVTLFTRGKAPIAQQLPGESEAEFSEFSSKILHLKGDRKDFDFVKTSLAAEGFDVVYDINGREAVEVEPILDALPNLEQYIYCSSAGVYLKTDYPPHYEVDAVDPKSRHKGKLETESLLASRDVNWTSIRPVYIYGPLNYNPVEEWFFHRLKAGRPIPVPNSGIQITQLGHVKDLATAFVKVLSNPKASKEVFNISGDKYVTFDGLARACAKAGGFPEPEIVHYNPKEFDFGKKKPFPFRDQHFFASIDKAKSLLGWTPEFDLVEGLTDSYNLDFGRGTFRKEADFSTDDIILGKSLVLQT

SEQ ID NO: 5731 - protein, 380 aa, Populus trichocarpa
MARLVAVQQQTQPSFSLLPSSLSDFNGTRLHSQVQCKRRVWQTKGALQVSASSSKNILIMGGTRFIGVFLSRLLVKEGHQVTLFTRGKAPITQQLPGESDQDYADFSSKILHLKGDRKDFEFVKTSLAAKGFDVVYDINGREAVEVEPILDALPKLEQFIYCSSAGVYLKSDLLPHSEKDAVDPKSRHKGKLETESLLESRGVNWTSIRPVYIYGPLNYNPVEEWFFHRLKAGRPIPIPNSGIQMTQLGHVKDLAKAFIQVLGNEKASQQVFNISGEKYVTFDGLAKACAKAAGFPEPEIVHYNPKDFDFGKKKAFPFRDQHFFASIDKAKHVLGWEPEFDLVEGLADSYNLDFGRGTYRKEADFFTDDLIIGKSLVLQA

SEQ ID NO: 5732 - protein, 380 aa, Populus trichocarpa
MARLVAMQQQTQPSLSLLPSSLSDFNGTRLHSQVQCKRRAWQTKRALQVSASSSKNILIMGGTRFIGVFLSRLLVKEGHQVTLFTRGKAPITQQLPGESDQDYADFSSKVLHLKGDRKDFEFVKTSLAAKGFDVVYDINGREAVEVEPILDALPKLEQFIYCSSAGVYLKSDLLPHSEKDAVDPKSRHKGKLETESLLESKGVNWTSIRPVYIYGPLNYNPVEEWFFHRLKAGRPIPIPNSGIQITQLGHVKDLAKAFVEVLGNDKASQQVFNISGEKYVTFDGLARACAKAAGFPEPVIVHYNPKEFDFGKKKAFPFRDQHFLASIDKARHVLGWEPEFDLVEGLADSYNLDFGRGTYRKEADFSTDDLILGKSLVLQA

SEQ ID NO: 5733 - protein, 378 aa, Trifolium pratense
MASMVAFQQNQLSFPPLASSLSDFTGTRLQTHIQLKRRTWQSKGALCVTASSTKKILIMGGTRFIGVFLSRQLVKEGHQVTLFTRGKAPITQQLPGESDTDFADFSSKILHLKGDRKDYDFVKSSLSAEGFDVVYDINGREAEEVEPILDALPNLEQFIYCSSAGVYLKSDLLPHAEVDAVDPKSRHKGKLETESLLQSKDVNWTSIRPVYIYGPLNYNPVEEWFFHRLKAGRPIPIPGSGIQITQLGHVKDLATAFLKVLENDKASKQIFNISGDKYVTFDGLAKACAKAGGFPEPEIVHYNPKDFDFGKKKSFPFRDQHFFASVEKAKSVLGLEPDFGLVEGLTDSYNLDFGRGTFRKEADFSTDDIILGKSLVNV

SEQ ID NO: 5734 - protein, 380 aa, Populus trichocarpa
MARLVAMQQQTQPSLSLLLSSLSDFNGTRLHSQVQCKRRAWQTKRALQVSASSSKNILIMGGTRFIGVFLSRLLVKEGHQVTLFTRGKAPITQQLPGESDQDYADFSSKVLHLKGDRKDFEFVKTSLAAKGFDVIYDINGREAVEVEPILDALPKLEQFIYCSSAGVYLKSDLLPHSEKDAVDPKSRHKGKLETESLLESKGVNWTSIRPVYIYGPLNYNPVEEWFFHRLKAGRPIPIPNSGIQITQLGHVKDLAKAFVEVLGNDKASQQVFNISGEKYVTFDGLARACAKAAGFPEPVIVHYNPKEFDFGKKKAFPFRDQHFFASIDKARHVLGWEPEFDLVEGLADSYNLDFGTGTYRKEADFSTDDLILGKSLVLQA

SEQ ID NO: 5735 - protein, 380 aa, Populus trichocarpa
MARLVAVQQQTQPSFSLLPSSLSDFNGTRLHSQVRCKRRVWQTKGALQVSASSSKNILIMGGTRFIGVFLSRLLVKEGHQVTLFTRGKAPITQPLPGESDQDYADFSSKILHLKGDRKDFEFVKTSLAAKGFDVVYDINGREAVEVEPILDALPKLEQFIYCSSAGVYLKSDLLPHSEKDAVDPKSRHKGKLETESLLESRGVNWTSIRPVYIYGPLNYNPVEEWFFHRLKAGRPIPIPNSGIQMTQLGHVKDLAKAFIQVLGNEKASQQVFNISGEKYVTFDGLAKACAKAAGFPEPEIVHYNPKDFDFGKKKAFPFRDQHFFASIDKAKHVLGWEPEFDLVEGLADSYNLDFGRGTYRKEADFFTDDLIIGKSLVLQA

SEQ ID NO: 5736 - protein, 253 aa, Fragaria vesca
MAKLVSVQRHPSVSLLPPSSLSDFNGTRLLHSHLQFKRRVSQPRGALQVSASSAKKILIMGGTRFIGIFLSRLLVKEGHQVTLFTRGKAPITQQLPGESDSDYTDFASKILHLKGDRKDFDFVKSSLSAEGFDVVYDINGREAEEIVPILDGLPKLEQYIYCSSAGVYLKSDQLPHFEIDAVDPKSRHKGKLETESLLESRGVNWTSIRPVYIYGPLNYNPVEEWFFHRLKAGRPIPVPNSGIQITQLGHVKI

SEQ ID NO: 5737 - protein, 379 aa, Solanum lycopersicum
MASLVAIQPKQPSFSLLPSSNSDFNGARLISSFQYKRKPCLSKGALQVTASSEKKILIMGGTRFIGVFLSRLLVKEGHQVTLFTRGKAPISQQLPGESDQDYADFSSKLLHLKGDRMDFDFVKSSLSAEGYDVVYDINGREATEVEPILDALPNLEQYIYCSSAGVYLKTDYLPHFEVDAGDPKSRHKGKLETESLLVSRDVNWTSLRPVYIYGPLNYNPVEEWFFHRLKAGRPIPIPNSGMQITQLGHVKDLAKAFVQVLGNEKASKQVFNISGEKYVTFDGLAKACAKAGGFPEPELVHYNPKEFDFGKKKAFPFRDQHFFTSIEKSKAELGWKPDFDLVEGLTDSYNLDFGRGTFRKAADFSTDDMILEKKLVPQS

SEQ ID NO: 5738 - protein, 383 aa, Malus domestica
MARLVAVQPQQRNPSFSLLPPSSLSDFNGTKLLHSQLQCKRRASQPRGGALQVSASSAKKILIMGGTRFIGIFLSRLLVKEGHQVTLFTRGKAPITQQLPGESDADYTDFASKILHLKGDRKDYDFVKSSLSAEGYDVVYDINGREAEEVVPIIEGLPKLEQYIYCSSAGVYLKSDQLPHFETDAVDPKSRHKGKLETENLLESKGVNWTSIRPVYIYGPLNYNPVEEWFFHRLKAGRPIPVPNSGIQITQLGHVKDLATAFIKVLGNEKASKQVFNISGDKYVTFDGLAKACAKAAGFPEPEIIHYNPKEFDFGKKKAFPFRDQHFFASIDKAKSVLGWKPEYGLVEGLADSYNLDFGRGTFRKAADFSTDDIILGKSLVLT

SEQ ID NO: 5739 - protein, 383 aa, Malus domestica
MARLVAVQPQQRNPSFSLLPPSSLSDFNGTKLLHSQLQCKRRASQPRGGALQVSASSAKKILIMGGTRFIGVFLSRLLVKEGHQVTLFTRGKAPITQQLPGESDADYTDFASKILHLKGDRRDYDFVKSSLSAEGYDVVYDINGREAEEVVPIIEGLPKLEQYIYCSSAGVYLKSDQLPHFEIDAVDPKSRHKGKLETESLLESKGVNWTSIRPVYIYGPLNYNPVEEWFFHRLKAGRPIPVPNSGIQITQLGHVKDLATAFIKVLGNEKASKQVFNISGDKYVTFDGLAKACAKAAGFPEPEIIHYNPKEFDFGKKKAFPFRDQHFFASIDKAKSVLGWKPEYDLVEGLADSYNLDFGRGTFRKAADFSTDDIILGKSLVLS

SEQ ID NO: 5740 - protein, 378 aa, Phaseolus coccineus
MARLVALQQNQLSFSPLASSLSDFSGTRLPTQLQLKRKLWQPKGSFYVSASSTKKILIMGGTRFIGVFLSRLLVKEGHQVTLFTRGKTPVTQQLPGESDSDYADFSSKILHLKGDRKDFEFVKSSLSAEGFEVVYDINGREADEVEPILDALPNLEQFIYCSSAGVYLKSDLLPHAETDAVDPKSRHKGKLETESLLQSKDVNWTSIRPVYIYGPLNYNPVEEWFFHRLKAGRPIPIPSSGIQITQLGHVKDLARAFVQVLGNDKASKEVFNISGEKYVTFDGLAKACAKAGGFPEPELVHYNPKDFDFGKKKSFPFRDQHFFASIEKAKRLVGWEPEFDLVGGLADSYNLDFGRGTFRKEADFSTDDIILGKKLVSV

SEQ ID NO: 5741 - protein, 378 aa, Vitis vinifera
MARLVVQHQNQPSFSLLPSSLSDFNGIRLTNHIQCRRKVCQPKGALHVTASGEKKILMMGGTRFIGVFLARLLVKEGHQVTLFTRGKAAITQQLPGESDKDYAEFSSKVLHLKGDRKDFEFVKTSLAAEGFDVVYDINGREAVEIEPILDALPNLQQYIYCSSAGVYKKSDLLPHCETDAVDPKSRHKGKLETESLLDSRGVNWTSIRPVYIYGPLNYNPVEEWFFHRLKAGRPIPIPNSGIQITQLGHVKDLAKAFLLVLSNEKASKQVFNISGEKYVTFDGLARACAKGAGFPEPEIVHYNPKEFDFGKKKAFPFRDQHFFASIEKAKSVLGWKPEFDLVEGLADSYNLDFGRGTFRKEADFSTDDIILGKSLVLT

SEQ ID NO: 5742 - protein, 379 aa, Unknown
  Sequence found in Organisms: Solanum tuberosum, Solanum phureja
MASLVAIQPKQPSFSVLPSSHSDFNGARLISSFQYKRKPCLSKGALQVTASSEKKILIMGGTRFIGVFLSRLLVKEGHQVTLFTRGKAPISQQLPGESDQDYADFSSKLLHLKGDRMDFDFVKSSLSAEGYDVVYDINGREATEVEPILDALPNLEQYIYCSSAGVYLKTDYLPHFEVDAGDPKSRHKGKLETESLLVSRDVNWTSLRPVYIYGPLNYNPVEEWFFHRLKAGRPIPIPNSGMQITQLGHVKDLAKAFVQVLGNEKASKQVFNISGEKYVTFDGLAKACAKAGGFPEPELVHYNPKEFDFGKKKAFPFRDQHFFTSIEKSKALLGWKPDFDLVEGLTDSYNLDFGRGTFRKAADFSTDDMILEKKLVPQS

SEQ ID NO: 5743 - protein, 378 aa, Glycine max
MARVVALQQNQLSFSPLASSLFDFSGTRLQTQLQFKRKLCHPKGSFYVSASSTKKILIMGGTRFIGVFLSRLLVKEGHQVTLFTRGKAPVTQQLPGESDNDYADFSSKILHLKGDRKDFDFVKSSLSAEGFDVVYDINGREADEVEPILDALPNLEQFIYCSSAGVYLKSDLLPHAETDAVDPKSRHKGKLETESLLQARGVNWTSIRPVYIYGPLNYNPVEEWFFHRLKAGRPIPIPSSGLQITQLGHVKDLATAFIQVLGNEKASKEVFNISGEKYVTFDGLARACAKAGGFPEPEIIHYNPKDFDFGKKKSFPFRDQHFFASIEKAKRVLGWEPEFGLVEGLADSYNLDFGRGTYRKEADFSTDDIILGKSLVSV

SEQ ID NO: 5744 - protein, 378 aa, Glycine max
MARVVALQQNQLSFSTLASSLSDFSGTRLQTQLQFKRKQCHPKGSFYVSASSTKKILIMGGTRFIGVFLSRLLVKEGHQVTLFTRGKAPVTQQLPGESDSDYADFSSKILHLKGDRKDFDFVKSSLSAEGFDVVYDINGREADEVEPILDALPNLEQFIYCSSAGVYLKSDLLPHAETDAVDPKSRHKGKLETESLLQARGVNWTSIRPVYIYGPLNYNPVEEWFFHRLKAGRPIPIPGSGIQITQLGHVKDLAKAFIQVLGNEKASKEVFNISGDKYVTFDGLARACAKAGGFPEPEIIHYNPKDFDFGKKKSFPFRDQHFFASVEKAKSVLGLEPEFGLVEGLADSYNLDFGRGTYRKEADFSTDDIILGKSLVSV

SEQ ID NO: 5745 - protein, 377 aa, Lotus japonicus
MARLVVPQQNQLSFSPLASSLSDFSGTRLQTQIQFRRKAWQPKGFHVSASSTKKILIMGGTRFIGVFLSRLLVKEGHQVTLFTRGKAPITQQLPGESDSDFSDFSSKIKHLKGDRKDYDFVKSSLSAEGFDVVYDINGREAEEVEPIIEALPNLEQFIYCSSAGVYLKSDLLPHAEVDAVDPKSRHKGKLETESLLQSKDVNWTSIRPVYIYGPLNYNPVEEWFFHRLKAGRPIPIPGSGIQITQLGHVKDLATVFVQVLGNDKASKQVFNIAGDKYVTFDGLARACAKAGGFPEPEIIHYNPKDFDFGKKKPFPFRDQHFFASVDKAKSVLGWEPEFGLVEGLADSYNLDFGRGTFRKEADFSTDDIILGKSLVSV

SEQ ID NO: 5746 - protein, 379 aa, Solanum melongena
MASLVAIQPKQPSFSVLPSSHSEFNGTRLISSFQYKRKPCRSRGALQVTASGEKKILIMGGTRFIGVFLSRLLVKEGHQVTLFTRGKAPISQQLPGESDQDYADFSSKLLHLKGDRMDFDFVRSSLSAEGYDVVYDINGREANEVEPILDALPNLEQYIYCSSAGVYLKTDYLPHFEADAGDPKSRHKGKLETESLLVSRGVNWTSLRPVYIYGPLNYNPVEEWFFHRLKAGRPIPIPNSGIQITQLGHVKDLANAFVKVLGNEKASKQVFNISGEKYVTFDGLARACAKAGGFPEPELVHYNPKEFDFGKKKAFPFRDQHFFTSIEKAKSLLGWKPELDLVEGLTDSYNLDFGRGTFRKAADFSTDDLILEKKLVPQS

SEQ ID NO: 5747 - protein, 380 aa, Rhizophora mangle
LVVAQQQALPSFFLSRSSLSDFNGTRLYSRVQCKRKSWHAKGAKGALQVKASASKNILIMGGTRFIGVFLSRLLVKEGHQVTLFTRGKAPITQRLPGESDQGYADFSSKILHLKGDRKDSEFVKSSLSAKGFDVVYDINGREADEVTPILDALPKLEQYISCSSAGVYPKSDIFPHAETDAVDPKSRHKGKFETESLLESKGVNWTSLRPVYIYGPLNYNPVEEWFFHRLKAGRPIPIPNSGMQITQLGHVKDLATAFVQVLGNEKASRQVFNISGEKYVTFDGLARACAKAGGFPEPEIIHYNPKEFDFGKKKAFPFRDQHFFASIEKAKHVLGWKPEFDLVEGLADSYNLDFGRGTFRKEADFSTDDIILGKTLVLQS

SEQ ID NO: 5748 - protein, 379 aa, Artemisia annua
MATSLQNNFKMHTSVSLLPSSQSSFSGTKFATSIQYKRKVCQPKGALNVMASSSKKILVMGGTRFIGIFLSRLLVEEGHQVTLFTRGKAPITQQLPGEEEAAYNAFKSKILHLKGDRKDYDFVKTSLAAEGFDVVYDINGREAEEVEPILDALPNLEQYIYCSSAGVYLKSDLLPHCETDAVDPKSRHKGKLETEALLQSKGVNYTSIRPVYIYGPLNYNPVEEWFFHRLKAGRPIPIPNSGLQVTQLGHVKDLATAFIKVLGNEKASKQIYNISGDRYVTFDGLARACAKAGGFPEPELIHYNPKEFDFGKKKAFPFRDQHFFASVEKAKAELGIIPEYGLVEGLTDSYNLDFGRGTFRKEADFTTDDIILGKSLVLS

SEQ ID NO: 5749 - protein, 378 aa, Nicotiana benthamiana
  misc_feature (2)..(2): Xaa can be any naturally occurring amino acid
  misc_feature (5)..(5): Xaa can be any naturally occurring amino acid
  misc_feature (35)..(35): Xaa can be any naturally occurring amino acid
  misc_feature (48)..(48): Xaa can be any naturally occurring amino acid
  misc_feature (50)..(50): Xaa can be any naturally occurring amino acid
  misc_feature (67)..(67): Xaa can be any naturally occurring amino acid
  misc_feature (74)..(74): Xaa can be any naturally occurring amino acid
  misc_feature (83)..(83): Xaa can be any naturally occurring amino acid
  misc_feature (109)..(109): Xaa can be any naturally occurring amino acid
  misc_feature (111)..(111): Xaa can be any naturally occurring amino acid
  misc_feature (122)..(122): Xaa can be any naturally occurring amino acid
  misc_feature (125)..(125): Xaa can be any naturally occurring amino acid
  misc_feature (133)..(133): Xaa can be any naturally occurring amino acid
  misc_feature (158)..(158): Xaa can be any naturally occurring amino acid
  misc_feature (166)..(166): Xaa can be any naturally occurring amino acid
  misc_feature (171)..(171): Xaa can be any naturally occurring amino acid
MXSLXAVQHKQPSFAVLPSSHSDFNGAKLISSLQXKRKPCQPKGALHXTXSSAKKILIMGGTRFIGXFLSRLLXKEGHQVTLXTRGKAPISQQLPGESDQDYADFSSKXLXLKGDRMDFNFXKSXLSAEGFDXVYDINGREAVEVEPILDALPNLEQXIYCSSAGXYLKTXYLPHFEADAVDPKSRHKGKLETESLLESRDVNWTSVRPVYIYGPLNYNPVEEWFFHRLKAGRPIPIPNSGLQITQLGHVKDLATAFIQVLGNEKASKQVFNISGEKYVTFDGLAKACAKAGGFPEPEIVHYNPKEFDFGKKKAFPFRDQHFFASVEKAKAVLGWKPEFELVEGLTDSYNLDFGRGTYRKEADFSTDDLILGKSLVLN

SEQ ID NO: 5750 - protein, 425 aa, Centaurea maculosa
MAALQTILIFIFFFFFIKHTLILISSSSSPSLSSPEKFFDQSWRPAVLQRCNITSKCSLPSHSFPSSQSSFCGTKFNTSIQYKRKVYQPKGALNVTASSAKKILVMGGTRFIGIFLSRLLVEEGHQVTLFTRGKAPITQPLPGEADEAYNAFKSKILHLKGDRQDFDFVKTSLAAEGFDVVYDINGREAVEVEPILDALPNLEQYIYCSSAGVYLKSDLLPHCETDAVDPKSRHKGKLETEALLASRGVNYTSIRPVYIYGPLNYNPVEEWFFHRLKAGRPIPIPNSGIQITQLGHVKDLAKAFIKVLGNEKASKQVYNISGDRYVTFDGLARACAKAGGFPEPEIIHYNPKEFDFGKKKAFPFRDQHFFASVEKAKAELGIIPEYGLVEGLTDSYNLDFGRGTFRKAADFTTDDMILGKSLVLS

SEQ ID NO: 5751 - protein, 382 aa, Cichorium intybus
MAGGVATVQHNLKMQPSVSLLPSSQSSFCGSKFTTSIQYKRKVCQPKGALNVTASSAKKILVMGGTRFIGIFLSRLLVEEGHQVTLFTRGKAPITQPLPGEADDAYNAFKSKILHLKGDRKDFDFVKTSLAAEGFDVVYDINGREAVEVEPILDALPNLEQYIYCSSAGVYLKSDLLPHCETDAVDPKSRHKGKLETEALLESKGVNYTSIRPVYIYGPLNYNPVEEWFFHRLKAGRPIPIPNSGLQVTQLGHVKDLATAFIKVLGNPKASKQVFNISGDRYVTFDGLARACAKAGGFPEPEIVHYNPKEFDFGKKKAFPFRDQHFFASVEKAKAELGVVPEYGLVEGLKDSYDLDFGRGTFRKAADFETDDIILGKSLVLS

SEQ ID NO: 5752 - protein, 383 aa, Cynara scolymus
  misc_feature (10)..(10): Xaa can be any naturally occurring amino acid
  misc_feature (23)..(23): Xaa can be any naturally occurring amino acid
  misc_feature (55)..(55): Xaa can be any naturally occurring amino acid
MAAAGVATLXHNFKMQPSISLLXSSQSSFCGTKFSPSIQYKRKVCQPKGALNVTXSSAKKILVMGGTRFIGIFLSRLLVEEGHQVTLFTRGKAPITQPLPGESDEAYNAFKSKVLHLKGDRKDFDFVKTSLAAEGFDVVYDINGREAVEVEPILDALPKLEQYIYCSSAGVYLKSDLLPHCETDAVDPKSRHKGKLETEALLESKGVNYTSIRPVYIYGPLNYNPVEEWFFHRLKAGRPIPIPNSGIQVTQLGHVKDLAKAFIKVLGNEKASKQVYNISGDRYVTFDGLARACAKAGGFPEPEIIHYNPKEFDFGKKKAFPFRDQHFFASVEKAKAELGIVPEYGLVEGLTDSYNLDFGRGTFRKEADFTTDDIILGKSLVLS

SEQ ID NO: 5753 - protein, 384 aa, Arachis hypogaea
MARFMAVTPSQQNNQLSFSPLASSLSDFSGTKLHYSHINFKRKQWQAKSASFYVSASSTKKILIMGGTRFIGVFLSRLLVKEGHQVTLFTRGKAPVTQQLPGESDSDYADFSSKILHLKGDRQDFEFVKSSLSAKGFDVVYDINGREAVEVEPILDALPNLEQFIYCSSAGVYLKSDLLPHAEVDAVDPKSRHKGKLETESLLQSRGVNWTSIRPVYIYGPLNYNPVEEWFFHRLKAGRPIPIPSSGLQITQLGHVKDLARAFVQVLGNDKASKEIFNISGDKYVTFDGLARACAKAGGFPEPELIHYNPKDYDFGKKKAFPFRDQHFFASTEKSKSVLGFENEFDLVGGLADSYNLDFGRGTYRKEADFSTDDIILGKTLVSV

SEQ ID NO: 5754 - protein, 384 aa, Arachis hypogaea
MARFMAVTPSQQNNQLSFSPLASSLSDFSGTKLHYSHINFKRKQWQAKSASFYVSASSTKKILIMGGTRFIGVFLSRLLVKEGHQVTLFTRGKAPVTQQLPGESDSDYADFSSKILHLKGDRQDFEFVKSSLSAQGFDVVYDINGREAVEVEPILDALPNLEQFIYCSSAGVYLKSDLLPHAEVDAVDPKSRHKGKLETESLLQSRGVNWTSIRPVYIYGPLNYNPVEEWFFHRLKAGRPIPIPSSGLQITQLGHVKDLARAFVQVLGNDKASKEIFNISGDKYVTFDGLARACAKAGGFPEPELIHYNPKDYDFGKKKAFPFRDQHFFASTEKSKSVLGFENEFDLVGGLADSYNLDFGRGTYRKEADFSTDDIILGKTLVSV

SEQ ID NO: 5755 - protein, 382 aa, Lactuca sativa
MAGGVATVQHNLKMQPSVSLLPSSQSSFCGTKFNTSVQYKRKVCQPKGALNVTASGAKKILVMGGTRFIGIFLSRLLVEEGHQVTLFTRGKAPITQPLPGEADEAYNAFKSKILHLKGDRKDFDFVKTSLAAEGFDVVYDINGREAVEVEPILDALPNLEQYIYCSSAGVYLKSDLLPHCETDAVDPKSRHKGKLETEALLESKGVNYTSIRPVYIYGPLNYNPVEEWFFHRLKAGRPIPIPNSGLQVTQLGHVKDLATAFIKVLGNPKASKQVFNISGDRYVTFDGLARACAKAGGFPEPELVHYNPKEFDFGKKKAFPFRDQHFFASVEKAKVELGVVPEYGLVEGLKDSYDLDFGRGTFRKAADFETDDIILGKSLVLS

SEQ ID NO: 5756 - protein, 382 aa, Helianthus annuus
MAASVATLQQNFKLPSSVSLISSSQSTFCGTKFTTSVQYKRKVCQPKGALNVTASSSKKILVMGGTRFIGIFLSRLLVEEGHQVTLFTRGKAPVTQPLPGEAEDAYNAFKSKILHLKGDRKDYDFVRTSLAAEGFDVVYDINGREAEEVEPILDALPNLEQYIYCSSAGVYLKSDLLPHREIDAVDPKSRHKGKLETEALLESKGVNYTSIRPVYIYGPLNYNPVEEWFFHRLKAGRPIPIPNSGLQVTQLGHVKDLATAFIKVLGNEKASKQVYNISGDRYVTFDGLARACAKAGGFPEPEIIHYNPKEFDFGKKKAFPFRDQHFFASVEKAKEELGIIPEYSLVEGLTDSYNLDFGRGTFRKAADFTTDDMILEKSLVLS

SEQ ID NO: 5757 - protein, 196 aa, Raphanus sativus
MATASVNMQSVFASGLATRKINTNKLFFAANFPNLKRNYPVGVRCMAEGEPMKDESAPSTSAAQPLSSSSPPPPPPRPTKPKVSTKFSDLLAFSGPAPERINGRLAMVGFVAALAVELSKGENVLAQISDGGVSWFLGTTAILTLASLVPLFKGITAESKSKGFMTSDAELWNGRFAMLGLVALAFTEFVKGGTLV

SEQ ID NO: 5758 - protein, 196 aa, Raphanus sativus
MATASVNMQSVFAGGLATRKINTNKLFFAGSLPNLKRNYPVGVRCMAEGEPMKDESAPSTSAAQPLSSSSPPPPPPRPTKPKVSTKFSDLLAFSGPAPERINGRLAMVGFVAALAVELSKGENVLAQISDGGVSWFLGTTAILTLASLVPLFKGITAESKSKGFMTSDAELWNGRFAMLGLVALAFTEFVKGGTLV

SEQ ID NO: 5759 - protein, 196 aa, Unknown
  Sequence found in Organisms: Brassica napus, Brassica oleracea
MATASVNMQSVFACGLATRKINTNKLFFAGNFPNLKRNYPVGVKCMAEGEPMKDESAPSTSAAKPLSSSSSPPPPPPPTKPKVSTKFSDLLAFSGPAPERINGRLAMVGFVAALAVELSKGENVLAQISDGGVSWFLGTTAILTLASLVPLFKGITAESKSKGFMTSDAELWNGRFAMLGLVALAFTEFVKGGTLV

SEQ ID NO: 5760 - protein, 194 aa, Unknown
  Sequence found in Organisms: Brassica napus, Brassica juncea, Brassica rapa
MATASVNMQSVFACGLATRKINTNKLFFAGNFPNLKRNYPVGVRCMAEGMKDESTPSTSAAQPLSSSSSPPPPPPPTKPKVSTKFSDLLAFSGPAPERINGRLAMVGFVAALAVELSKGENVLAQISDGGVSWFLGTTAILTLASLVPLFKGITAESKSKGFMTSDAELWNGRFAMLGLVALAFTEFVKGGTLV

SEQ ID NO: 5761 - protein, 195 aa, Brassica napus
MAMASFNMQSVFAGGLTTRKINTNKLCFAGNFHNLKRNCPVGVRCMAEGEPMKDESAPSTSASQPLPKSSSPPPPPPTKPKVSTKFSDLLAFSGPAPERINGRLAMVGFVAALAVELSKGENVLAQISDGGVSWFLGTAAILTLASLVPLFKGITAESKSKGFMTSDAELWNGRFAMLGLVALAFTEFVKGGTLV

SEQ ID NO: 5762 - protein, 195 aa, Brassica napus
MATASFNMQSVFAGGLTTRKINTNKLCFAGNFHNLKRNYPVGVRCMAEGEPMKDESAPSTSVSQPLPKSSSPPPPPPTKPKVSTKFSDLLAFSGPAPERINGRLAMVGFVAALAVELSKGENVLAQISDGGVSWFLGTAAILTLASLVPLFKGITAESKSKGLMTSDAELWNGRFAMLGLVALAFTEFVKGGTLV

SEQ ID NO: 5763 - protein, 194 aa, Brassica napus
MATASFNMQSVFAGGLTTRKINTNKLCFAGNFHNLKRNYPVGVRCMAEGEPMKDESAPSTSVSQPLPKSSSPPPPPPTKPKVSTKFSDLLAFSGPAPERINGRLAMVGFVALAVELSKGENVLAQISDGGVSWFLGTAAILTLASLVPLFKGITAESKSKGLMTSDAELWNGRFAMLGLVALAFTEFVKGGTLV

SEQ ID NO: 5764 - protein, 195 aa, Brassica rapa
MAMASFNMQSVFAGGLTTCKINTNKLCFAGNFHNLKRNYPVGVRCMAEGEPMKDESAPSTSASQPLPKSSSPPPPPPTKPKVSTKFSDLLAFSGPAPERINGRLAMVGFVAALAVELSKGENILAQISDGGVSWFLGTAAILTLASLVPLFKGITAESKSKGFMTSDAELWNGRFAMLGLVALAFTEFVKGGTLV

SEQ ID NO: 5765 - protein, 194 aa, Brassica napus
MAMASFNMQSVFAGGLTTRKINTNKLCFAGNFHNLKRNCPVGVRCMAEGEPMKDESAPSTSASQPLPKSSSPPPPPPTKPKVSTKFSDLLAFSGPAPERINGRLAMVGFVALAVELSKGENVLAQISDGGVSWFLGTAAILTLASLVPLFKGITAESKSKGFMTSDAELWNGRFAMLGLVALAFTEFVKGGTLV

SEQ ID NO: 5766 - protein, 187 aa, Brassica juncea
MATASVNMQSVFACGLATRKINTNKLFFAGNFPNLKRNYPVGVRCMAEGMKDESTPSTSAAQPLSSSSSPPPPPPPTKPKVSTKFSDLLAFSGPAPERINGRLAMVGFVAALAVELSKGENVLAQISDGGVSWFLGTTAILTLASLVPLFKGITAESKSKGFMTSDAELWHGRFAMLGLVALAFTEF

SEQ ID NO: 5767 - protein, 194 aa, Brassica juncea
MAMASFNMQSVFAGGLTTCKINTNKLCFAGNFHNLKRNCPVGVRCMAEGEPMKDESAPSTSASQPLPKSSSPPPPPTKPKVSTKFSDLLAFSGPAPERINGRLAMVGFVAALAVELSKGENVLAQISDGGVSWFLGTAAILTLASLVPLFKGITAESKSKGFMTSDAELWNGRFAMLGLVALAFTEFVKGGTLV

SEQ ID NO: 5768 - protein, 196 aa, Brassica juncea
MATASFNMQSVFAGGLTTRKINTNNLFFAGNFPNLKRNFPVGVRCMVEGEPMKDESTPSTSAAQPLPKSSSPPPPPPPTKPKVSTKFSDLLAFSGPAPERINGRLAMVGFVAALAVELSKGENVFAQISDGGVSWFLGTTAILTLASLVPLFQGITAESKSKGFMTSNAELWNGRFAMLGLVALAFTEFVKGGTLI

SEQ ID NO: 5769 - protein, 196 aa, Brassica rapa
MATASFNMQSVFAGGLTTRKINTNNLFFAGNFPNLKRNFPVGVRCMAEGEPMKDESTPLTSAAQPLPKSSSPPPPPPPTKPKVSTKFNDLLAFSGPAPERINGRLAMVGFVAALAVELSKGENVFAQISDGGVSWFLGTTAILTLASLVPLFQGITAESKSKGFMTSNAELWNGRFAMLGLVALAFTEFVKGGTLI

SEQ ID NO: 5770 - protein, 193 aa, Brassica juncea
MATASFNMQSVFAGGLTTRKINTNNLFFAGNFPNLKRNFPVGVRCMVEGEPMKDESTPSTSAAQPLPKSSSPPPPTKPKVSTKFSDLLAFSGPAPERINGRLAMVGFVAALAVELSKGENVFAQISDGGVSWFLGTTAILTLASLVPLFQGITAESKSKGFMTSNAELWNGRFAMLGLVALAFTEFVKGGTLI

SEQ ID NO: 5771 - protein, 196 aa, Raphanus sativus
MATASFNMQSVFAGGLTLRKINTNNLFFAGNFPNLKRKFPVGVRCMAEGEPMKDESAPSTSAAQPLPKSSSPPPPPPPTKPKVSTKFSDLLAFSGPAPERINGRLAMVGFVAALAVELSKGENVFAQISDGGVSWFLGTTAILTLASLVPLFQGVTVESKSKGFMTSNAELWNGRFAMLGLVALAFTEFVKGGTLI

SEQ ID NO: 5772 - protein, 194 aa, Brassica juncea
MATASFNMQSVFAGGLTNRKINTNKLCFAGNFHNLKRNCPVGVRCMAEGEPMKDESAPSTSASQPLPKSSSPPPPPTKPKMSTKFSDLLAFSGPAPERINGRLAMVGFVAALAVELSKGENVLAQISDGGVSWFLGTAAILTLASLVPLYKGISAESKSKGFMTSNAELWNGRFAMLGLVALAFTEFVKGGTLV

SEQ ID NO: 5773 - protein, 193 aa, Brassica juncea
MATASFNMQSVFAGGLTIRKINTNNLYLAGSFPNLKRNFPVGVRCMAEGEPMKDESAPSTSAAQPLPKSSSPPPPTKPKVSTKFSDLLAFSGPAPERINGRLAMVGFVAALAVELSKGENVFAQISDGGVSWFLGTTAILTLASLVPLFQGITAESKSKGFMTSNAELWNGRFAMLGLVALAFTEFVRGGTLI

SEQ ID NO: 5774 - protein, 195 aa, Arabidopsis thaliana
MATASFNMQSVFAGGLTTRKINTNKLFSAGSFPNLKRNYPVGVRCMAEGGPTNEDSSPAPSTSAAQPLPKSPSPPPPMKPKVSTKFSDLLAFSGPAPERINGRLAMVGFVAALAVELSKGENVLAQISDGGVSWFLGTTAILTLASLVPLFKGISVESKSKGIMTSDAELWNGRFAMLGLVALAFTEFVKGGTLV

SEQ ID NO: 5775 - protein, 197 aa, Thellungiella halophila
MATTSFNMQSVFAGGLTTRKINTNKLSFAGNFSNLKRNYPVGVRCMAEGDPMKDESTTPSTSAAQPMPKASSPPPPPPPTKPKVSTKLGDLLAFSGPAPERINGRLAMVGFVAALAVELSKGENVLTQISDGGVSWFLVTTAIFTFASFVPLLKGITAESKSKGLFTSDAELLNGRFAMLGLVALAFTEFVKGGTLV

SEQ ID NO: 5776 - protein, 183 aa, Arabidopsis lyrata
MATASFNMQSVFAGGLTTRKINGNKLFFAGTFPSLKRNYPVGVRCMAEGEPKNEDSAPTSAAPPPTKPKVSTKFSDLLAFSGPAPERINGRLAMVGFVAALAVELSKGENVFAQISDGGVSWFLGTTAILTLASLVPLFKGITAESKSDGIMTSDAELWNGRFAMLGLVALAFTEFVKGGTLV

SEQ ID NO: 5777 - protein, 213 aa, Unknown
  Sequence found in Organisms: Brassica napus, Brassica rapa
MALEVCVKAAVGAPDALGDCPFSQRVLLTLEEKNLPYKMHLINISDKPQWFLAISPEGKVPVLKNDDKWVSDSDVITGILEEKYPEPSLKTPPEFASVGSKIFGTFVTFLKSKDSSDGSEKALLDELEALETHLKTHDGPFIAGGKVSAVDLSLAPKLYHLKVALGHYKSWSVPESLPHVHGYMKALFSLDSFEKTKTEERYVIAGWEHKVNP

SEQ ID NO: 5778 - protein, 213 aa, Unknown
  Sequence found in Organisms: Brassica napus, Brassica oleracea
MALEVCVKAAVGAPDALGDCPFSQRVLLTLEEKNLPYKMHLINISDKPQWFLAISPEGKVPVLKNDDKWVSDSDVITGILEEKYPEPSLKTPPELASVGSKIFGTFVTFLKSKDSSDGSEKALLDELEALETHLKTHDGPFIAGGKVSAVDLSLAPKLYHLKVALGHYKSWSVPESLPHVHGYMKALFSLDSFEKTKTEERYVIAGWEHKVNP

SEQ ID NO: 5779 - protein, 213 aa, Brassica juncea
MALEVCVKAAVGAPDVLGDCPFSQRVLLTLEEKNLPYKMHLINISDKPQWFLAISPEGKVPVFKNDDKWVSDSDVITGILEEKYPEPSLKTPPEFASVGSKIFGTFVTFLKSKDSSDGSEKALLDELEALETHLKTHDGPFIAGGKVSAVDLSLAPKLYHLKVALGHYKSWSVPESLPHVHGYMKALFSLDSFEKTKTEEKYVIAGWEHKVNP

SEQ ID NO: 5780 - protein, 213 aa, Brassica juncea
MALEVCVKAAVGAPDVLGDCPFSQRVLLTLEEKNLPYKMHLINISDKPQWFLAISPEGKVPVFKNDDKWVSDSDVITGILEEKYPEPSLKTPPEFASVGSKIFGTFVTFLKSKDSSDGSEKALLDELEALENHLKTHDGPFIAGGKVSAVDLSLAPKLYHLKVALGHYKSWSVPESLPHVHGYMKALFSLDSFQKTKTEEKYVIAGWAHKVNP

SEQ ID NO: 5781 - protein, 213 aa, Raphanus sativus
MALEVCVKAAVGAPDVLGDCPFSQRVLLTLEEKNLPYKMHLINVSDKPQWFLAISPEGKVPVLKNDDKWVPDSDVITGILEEKYPEPSLKTPPEFASVGSKIFGAFVTFLKSKDSSDGSEKALLDELEALENHLKTHDGPFIAGGKVSAVDLSLAPKLYHLKVALGHYKSWSVPESLPHVHGYMKALFSLDSFEKTKTEEKYVIAGWEHKVNP

SEQ ID NO: 5782 - protein, 213 aa, Raphanus sativus
MALEVCVKAAVGAPDVLGDCPFSQRVLLTLEEKHLPYKMHLINVSDKPQWFLAISPEGKVPVLKNDDKWVPDSDVITGILEEKYPEPSLKTPPEFASVGSKIFGTFVTFLKSKDSSDGSEKALLDELEALENHLKTHDGPFIAGGKVSAVDLSLAPKLYHLKVALGHYKSWSVPESLPHVHGYMKALFSLDSFEKTKTEEKYVIAGWEHKVNP

SEQ ID NO: 5783 - protein, 213 aa, Raphanus sativus
MALEVCVKAAVGAPDVLGDCPFSQRVLLTLEEKHLPYKMHLINVSAKPQWFLAISPEGKVPVLKNDDKWVPDSDVITGILEEKYPDPSLKTPPEFASVGSKIFGTFVTFLKSKDSSDGSEKALLDELEALENHLKTHDGPFIAGGKATAVDLSLAPKLYHLKVALGHYKSWSVPESLPHVHGYMKALFSLDSFEKTKTEEKYVIAGWEHKVNP

SEQ ID NO: 5784 - protein, 213 aa, Raphanus sativus
  misc_feature (7)..(7): Xaa can be any naturally occurring amino acid
  misc_feature (24)..(24): Xaa can be any naturally occurring amino acid
  misc_feature (176)..(176): Xaa can be any naturally occurring amino acid
  misc_feature (191)..(191): Xaa can be any naturally occurring amino acid
MALEVCXKAAVGAPDVLGDCPFSXRVLLTLEEKNLPYKMHLINVSDKPQWFLAISPEGKVPVLKNDDKWVPDSDVITGILEEKYPEPSLKTPPEFASVGSKIFGAFVTFLKSKDSSDGSEKALLDELEALEAHLKTHDGPFIAGGKVSAVDLSLAPKLYHLKVALGHYKSWSVPEXLPHVHGYMKALFSLXSFEKTKTEEKYVIAGWEHKVNP

SEQ ID NO: 5785 - protein, 213 aa, Raphanus sativus
MALEVCVKAAVGAPDVLGDCPFSQRVLLTLEEKHLPYKMHLINVSDKPQWFLAISPEGKVPVLKNDDKWVPDSDVITGILEEKYPEPSLKTPPELASVGSKIFGTFVAFLKSKDSSDGSEKALLDELEALENHLKTHDGPFIAGGKATAVDLSLAPKLYHLKVALGHYKSWSVPESLPHVHGYMNALFSLDSFEKTKTEEKYVIAGWEHKVNP

SEQ ID NO: 5786 - protein, 51 aa, Raphanus sativus
  misc_feature (32)..(32): Xaa can be any naturally occurring amino acid
MALEVCVKAAVGAPDVLGDCPFSQRVLLTLEXSIYPTKCISLTSPTNLNGS

SEQ ID NO: 5787 - protein, 175 aa, Brassica juncea
MHLINLSDKPKWFLDINPGGKVPVLKIDGKWVSDSDIITGILEEKYPEPSLKTPPEFASVGSKIFGTFVTFLKSKDSSDGSEKALLDELEALETHLKTHDGPFIAGGKVSAVDLSLAPKLYHLKVALGHYKSWSVPESLPHVHGYMKALFSLDSFEKTKTEERYVIAGWEHKVNP

SEQ ID NO: 5788 - protein, 213 aa, Thellungiella halophila
MALEVCVKAAVGAPDKLGDCPFSQRVLLTLEEKSLPYKIHLINISDKPQWFLDISPQGKVPVLKIDGKWVSDSDVIVGILEDKYPEPSLKTPPRFASVGSQIFSTFVAFLKSKDSHDRTEHALLHELEALENHLKTHDGPFIAGERVTAVDLSLAPKLYHLEVALGHFKSWSVPGSLPHVHNYMKALFSLDSFEKTKTEEKYVISGWAPKVHP

SEQ ID NO: 5789 - protein, 213 aa, Arabidopsis thaliana
MALEICVKAAVGAPDHLGDCPFSQRALLTLEEKSLTYKIHLINLSDKPQWFLDISPQGKVPVLKIDDKWVTDSDVIVGILEEKYPDPPLKTPAEFASVGSNIFGTFGTFLKSKDSNDGSEHALLVELEALENHLKSHDGPFIAGERVSAVDLSLAPKLYHLQVALGHFKSWSVPESFPHVHNYMKTLFSLDSFEKTKTEEKYVISGWAPKVNP

SEQ ID NO: 5790 - protein, 182 aa, Brassica juncea
EKNLPYKMHLINISDKPQWFLAISPEGKVPVFKNDDKWVSDSDVITGILEEKYPEPSLKTPPEFASVGSKIFGTFVTFLKSKDSSDGSEKALLDELEALENHLKTHDGPFIAGGKVSAVDLSLAPKLYHLKVALGHYKSWSVPESLPHVHGYMKALFSLDSFEKTKTEEKYVIAGWEHKVNP

SEQ ID NO: 5791 - protein, 213 aa, Raphanus sativus
MALEVCVKAAVGAPDALGDCPFSQRVLLTLEEKNQPYKIHLINLSDKPQWFLDINPQGKVPVLKMDDKWVPDSDIIVNILDDKYPDPSLKTPPQFASVGSNIFSTFVSFVKSKDSNDGTEKALVDELQALEDHLKSHDGPFIAGGRVTAVDLSLAPKLHYLEVALGHFKSWSVPGSLPHVRAYMKALFSLDSFEKTKTEEKYVIAGWVPKVNP

SEQ ID NO: 5792 - protein, 213 aa, Raphanus sativus
MALEVCVKAAVGAPDALGDCPFSQRVLLTLEEKNQPYKIHLINLSDKPQWFLDINPQGKVPVLKMDDKWVPDSDIIVNILDDKYPDPSLKTPPQFASVGSSIFSTFVSFIKSKDSNDGTEKALLDELQALEDHLKSHDGPFIAGGRVTAVDLSLAPKLHYLEVALGHFKTWSVPGTLPHVRTYMKALFSLDSFEKTKTEEKYVIAGWAPKVNP

SEQ ID NO: 5793 - protein, 213 aa, Raphanus sativus
MALEVCVKAAVGAPDALGDCPFSQRVLLTLEEKNQPYKIHLINLSDKPQWFLDINPQGKVPVLKMDDKWVPDSDIIVNILDDKYPDPSLKTPPQFASVGSSIFSTFVSFIKSKDSNDGTEKALVDELQALEDHLKSHDGPFIAGGRVTAVDLSLAPKLHYLEVALGHFKTWSVPGTLPHVRTYMKALFSLDSFEKTKTEEKYVIAGWAPKVNP

SEQ ID NO: 5794 - protein, 244 aa, Arabidopsis lyrata
MALEICVKAAVGAPDHLGDCPFSQRALLTLEEKNLTYKIHLINLSDKPQWFLDISPQGKVPVLKIDDKWVTDSDVIVGILEEKYPDPPLKTPPEFASVGSNIFSTFGTFLKSKDSNDGSEQALLHELEALENHLKSHDGPFIAGERVSAVDLSLAPKLYHLQVALGHFKSWSVPASLPHVHNYMKDLFSLDSFEKTKTEEKVKLGSLNSKRRIYSEGGKVALHKDRMDQTHQKIHWRSSLCKCK

SEQ ID NO: 5795 - protein, 213 aa, Arabidopsis lyrata
MALDICVKVAVGAPDVLGDCPFSQRVLLTLEEKKLPYKTHLINVSDKPQWFLDISPEGKVPVVKLDGKWVADSDVIVGLLEEKYPEPSLKTPPEFASVGSKIFGAFVTFLKSKDANDGSEKALVDELEALENHLKTHSGPFVAGEKVTAVDLSLAPKLYHLEVALGHYKNWSVPESLTNVRNYAKALFSRESFEKTKAKKEIVVAGWESKVKA

SEQ ID NO: 5796 - protein, 212 aa, Cleome gynandra
MALEVCVKAAVGAPDVLGDCPFSQRVLLTLEEKKLPYKMHLINVSDKPKWFLDVNPEGKVPVIKFDGKWVSDSDVIVGIIEEKYPEPSLKTPPEFASVGSKIFGAFVTFLKSKDANDGSEKTLLDELKALDDHLKTHGPYVAGEKVTAVDLSLAPKLYHLEVALGHFKKWSIPESLSNVCNYMKALFSRESFEKTKAAKEYVIAGWAPKVNA

SEQ ID NO: 5797 - protein, 508 aa, Brassica napus
MEKGSNGSAALEMQTSELDQPAALRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPRTRAIAIFALGFWILDVANNTLQGPCRAFLADLSAGNAKKTRTANAFFSFFMAVGNVLGYAAGSYKNLYKVVPFTMTKSCDLYCANLKTCFFLSITLLLLVTFMSLCYVTEKPWTPEPTADGKSSSVPFFGEIFGAFKELKRPMWMLLIVTALNWIAWFPFLLFDTDWMGREVYGGNSDATASDASKKLYNDGVRAGALGLMLNAIVLGFMSLGVEWVGRKMGGAKRLWGAVNFILAICLAMTVVVTKQAENHRRDHGGAKTGPPGNVTAGALTLFAVLGIPQAITFSIPFALASIFSTNSGAGQGLSLGVLNLAIVVPQMVVSVGGGPFDELFHGGNIPAFVLGAIAAAVSGILALTVLPSPPPDAPAFKTGAMGFH

SEQ ID NO: 5798 - protein, 508 aa, Brassica oleracea
MEKGSNGSAALEMQTSELDQPAALRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPRTRAIAIFALGFWILDVANNTLQGPCRAFLADLSAGNAKKTRTANAFFSFFMAVGNVLGYAAGSYKNLYKVVPFTMTKSCDLYCANLKTCFFLSITLLLLVTFMSLCYVTEKPWTPEPTADGKPSSVPFFGEIFGAFKELKRPMWMLLIVTALNWIAWFPFLLFDTDWMGREVYGGNSDATATDASKKLYNDGVRAGALGLMLNAIVLGFMSLGVEWAGRKMGGAKRLWGAVNFILAICLAMTVVVTKQAENHRRDHGGAKTGPPGNVTAGALTLFAVLGIPQAITFSIPFALASIFSTNSGAGQGLSLGVLNLAIVVPQMVVSVGGGPFDELFHGGNIPAFVLGAIAAAVSGILALTVLPSPPPDAPAFKTGAMGFH

SEQ ID NO: 5799 - protein, 508 aa, Raphanus sativus
  misc_feature (156)..(156): Xaa can be any naturally occurring amino acid
  misc_feature (256)..(256): Xaa can be any naturally occurring amino acid
  misc_feature (268)..(268): Xaa can be any naturally occurring amino acid
MEKASNGSSALEMHTSELDQPAALRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPRTRAIAIFALGFWILDVANNTLQGPXRAFLADLSAGNAKKTRTANAFFSFFMAVGNVLGYAAGSYKNLYKVVPFTMTKSCDLYCANLKTCFFISITLLLLVTFMSLCYVTEKPWTPEPTADGKASXVPFFGEIFGAFXELKRPMWMLLIVTALNWIAWFPFLLFDTDWMGREVYGGNSDATASTASKKLYNDGVRAGALGLMLNAIVLGFMSLGVEWVGRKMGGAKRLWGAVNFILAICLAMTVVVTKQAEDHRRDHGGAKTGPPGSVTAGALTLFAVLGIPQAITFSIPFALASIFSTNSGAGQGLSLGVLNLAIVVPQMVVSVGGGPFDELFHGGNIPAFVLGAIAAAVSGILALTVLPSPPPDAPAFKTGAMGFH

SEQ ID NO: 5800 - protein, 508 aa, Brassica napus
MEKGSNGSAALEMQTSELDQPAALRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPRTRAIAIFALGFWILDVANNTLQGPCRAFLADLSAGNAKKTRTANAFFSFFMAVGNVLGYAAGSYKNLYKVVPFTMTKSCDLYCANLKTCFFLSITLLVLVTFISLCYVKEKPWTPEPTADGEASSVPFFGEIFGAFKELKRPMWMLLIVTALRGIAWFPFLLFDTDWMGREVYGGNSDATASATAKKLYNDGVRAGALGLMLNAIVLGFMSLGVEWVGRKMGGAKRLWGVVNFILAICLAMTVLVTKQAENHRRDHGGAKTGPPGNVTAGALTLFAVLGIPQAITFSIPFALASIFSSNSGAGQGLSLGVLNLAIVVPQMVVSVGGGPFDEIFGGGNIPAFVLGAIAAAVSGILALTVLPSPPPDAPAFKTGAMGFH

SEQ ID NO: 5801 - protein, 507 aa, Arabidopsis thaliana
MEKAANGASALETQTGELDQPERLRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPKTRAIAIFALGFWILDVANNTLQGPCRAFLADLSAGNAKKTRTANAFFSFFMAVGNVLGYAAGSYRNLYKVVPFTMTESCDLYCANLKTCFFLSITLLLIVTFVSLCYVKEKPWTPEPTADGKASNVPFFGEIFGAFKELKRPMWMLLIVTALNWIAWFPFLLFDTDWMGREVYGGNSDATATAASKKLYNDGVRAGALGLMLNAIVLGFMSLGVEWIGRKLGGAKRLWGIVNFILAICLAMTVVVTKQAENHRRDHGGAKTGPPGNVTAGALTLFAILGIPQAITFSIPFALASIFSTNSGAGQGLSLGVLNLAIVVPQMVISVGGGPFDELFGGGNIPAFVLGAIAAAVSGVLALTVLPSPPPDAPAFKATMGFH

SEQ ID NO: 5802 - protein, 513 aa, Brassica napus
  misc_feature (308)..(308): Xaa can be any naturally occurring amino acid
MVSHQMEKASNGTSALETQTAELDQPAALRKIISVSSIAAGVQFGWALQLSLLTPYVQLLGIQHKWASLIWLCGPISGMLVQPIVGYHSDRCTSRFGRRRPFIVAGAGLVTVAVFLIGYAADLGHSMGDQLNKPPRTRAIAIFALGFWILDVANNTLQGPCRAFLADLSAGNAKKTRTANAFFSFFMAVGNVLGYAAGSYRDLYKMVPFTMTESCDLYCANLKTCFFLSITLLVLVTFVSLCYVKEKPWTPEPTADGKASNVPFFGEIFGAFKELKRPMWMLLIVTALNWIAWFPFLLFDTDWMGREXYGGNSDATASATAKKLYNDGVRAGALGLMLNAIVLGFMSLGVEWVGRKMGGAKRLWGVVNFILAICLAMTVLVTKQAENHRRDHGGAKTGPPGNVTAGALTLFAVLGIPQAITFSIPFALASIFSSNSGAGQGLSLGVLNLAIVVPQMVVSVGGGPFDEIFGGGNIPAFVLGAIAAAVSGILALTVLPSPPPDAPAFKTGAMGFH

SEQ ID NO: 5803 - protein, 512 aa, Arabidopsis thaliana
MVSHPMEKAANGASALETQTGELDQPERLRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPKTRAIAIFALGFWILDVANNTLQGPCRAFLADLSAGNAKKTRTANAFFSFFMAVGNVLGYAAGSYRNLYKVVPFTMTESCDLYCANLKTCFFLSITLLLIVTFVSLCYVKEKPWTPEPTADGKASNVPFFGEIFGAFKELKRPMWMLLIVTALNWIAWFPFLLFDTDWMGREVYGGNSDATATAASKKLYNDGVRAGALGLMLNAIVLGFMSLGVEWIGRKLGGAKRLWGIVNFILAICLAMTVVVTKQAENHRRDHGGAKTGPPGNVTAGALTLFAILGIPQAITFSIPFALASIFSTNSGAGQGLSLGVLNLAIVVPQMVISVGGGPFDELFGGGNIPAFVLGAIAAAVSGVLALTVLPSPPPDAPAFKATMGFH

SEQ ID NO: 5804 - protein, 512 aa, Arabidopsis lyrata
MVSHPMEKAANGASALETQTGELDQPERLRKIISVASIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLNKPPRTRAIAIFALGFWILDVANNTLQGPCRAFLADLSAGNAKKTRTANAFFSFFMAVGNVLGYAAGSYRNLYKVVPFTMTESCDLYCANLKTCFFLSITLLLLVTFVSLCYVKEKPWTPEPTADGKASNVPFFGEIFGAFKELKRPMWMLLIVTALNWIAWFPFLLFDTDWMGREVYGGDSDAKATAVAKKLYNDGVRAGALGLMLNAIVLGFMSLGVEWIGRKLGGAKRLWGIVNFILAICLAMTVVVTKQAENHRRDHGGAKTGPPGNVTAGALTLFAVLGIPQAITFSIPFALASIFSTNSGAGQGLSLGVLNLAIVVPQMVVSVGGGPFDELFGGGNIPAFVLGAIAAAVSGVLALTVLPSPPPDAPAFKATMGFH

SEQ ID NO: 5805 - protein, 415 aa, Brassica napus
RRPFIVAGAGLVTVAVFLIGYAADIGHSMGDQLDKPPRTRAIAIFALGFWILDVANNTLQGPCRAFLADLSAGNAKKTRTANAFFSFFMAVGNVLGYAAGSYKNLYKVVPFTMTKSCDLYCANLKTCFFLSITLLLLVTFMSLCYVTEKPWTPEPTADGKPSSVPFFGEIFGAFKELKRPMWMLLIVTALNWIAWFPFLLFDTDWMGREVYGGNSDATASVASKKLYNDGVRAGALGLMLNAIVLGFMSLGVEWVGRKMGGAKRLWGAVNFILAICLAMTVVVTKQAENHRRDHGGAKTGPPGNVTAGALTLFAVLGIPQAITFSIPFALASIFSTNSGAGQGLSLGVLNLAIVVPQMVVSVGGGPFDELFHGGNIPAFVLGAIAAAVSGILALTVLPSPPPDAPAFKTGAMGFH

SEQ ID NO: 5806 - protein, 195 aa, Brassica napus
MAEETKNVHEHEAPKVATEESSTATGEVTDRGLFDFLGKKKDETKPEETIDSEFEQKVHISEPVPEVKHEEEGEEKKHSLLEKLHRSDSSSSSSSEEEGEDGVKRKKKKDKKKVTTTEGEVKTEEEKKGFMDKLKEKLPGHGKKPEDASPAPVVAPPVEEAHPAEKKGILEKIKEKLPGYHPKTVEEEKKDKDDH

SEQ ID NO: 5807 - protein, 195 aa, Brassica rapa
MAEETKNVHEHEVPKVATEESSTATGEVTDRGLFDFLGKKKDETKPEETIDSEFEQKVHISEPVPEVKHEEEKEEKKHSLLEKLHRSDSSSSSSSEEEGEDGVKRKKKKDKKKVTTTEGEVKTEEEKKGFMDKLKEKLPGHGKKPEEASPAPVVAPPVEEAHPTEKKGILEKIKEKLPGYHPKTVEEEKKDKDDN

SEQ ID NO: 5808 - protein, 195 aa, Unknown
  Sequence found in Organisms: Brassica napus, Zea mays
MADETKNVHEHEAPKVATEESSTATGEVTDRGLFDFLGKKKDETKPEETIDSEFEQKVHISEPVPEVKHEEEKEEKKHSLLEKLHRSDSSSSSSSEEEGEDGVKRKKKKDKKKVTTTEGEVKTEEEKKGFMDKLKEKLPGHGKKPEEPSPAPVVAPPVEEAHPAEKKGILEKIKEKLPGYHPKTVEEEKKDKDDH

SEQ ID NO: 5809 - protein, 199 aa, Brassica oleracea
MAEETKNVHEHEAPKVATEESSTATGEVTDRGLFDFLGKKKDETKPEETIDSEFEQKVHISEPVPEVKHEEEKEEKKHSLLEKLHRSDSSSSSSSEEEGEDGVKRKKKKDKKKVTATEGEVKTEEEKKGFMDKLKEKLPGHGKKPEEKPEDASPAPVVAPPVEEAHPAEKKGILEKIKEKLPGYHSKTVEEEKKDKDDH

SEQ ID NO: 5810 - protein, 190 aa, Brassica nigra
MAEETKNIHEHEVPKVATEESSAATAEVTDRGLFDFLGKKKDETKPEETIDSEFEQKVHISEPVPEVKHEEEEEKKPSLLEKLHRSDSSSSSSSEEEGEDGVKRKKKKDKKKTTTTEGEVKTEEEKKGFMEKLKEKLPGHGKKPEEASAPAAAPVVAPPVEEAHPAEKKGILEKIKEKLPGYHAKTVEEE

SEQ ID NO: 5811 - protein, 196 aa, Brassica juncea
MAEETKNVVHEHEVPKVTTEESSAEVTDRGLFDFLGKKKEETKPEETIDSEFEHKVHISEPVVPEVKHEEEEKKHSLLEKLHRSDSSSSSSSEEEGEDGEKRKKKKDKKKTATTAEGEVKTEEEKKGFMDKLKEKLPGHGKKPEDASPAAAAPVVAPPVEEAHPAEKKGILEKIKEKLPGYHPKTVDEVKKEKESD

SEQ ID NO: 5812 - protein, 194 aa, Brassica oleracea
MAEETKNVVHEQEVPKVTTEESSAEVTDRGLFDFLGKKKEETKPEETIDSEFEHKVHISEPVVPEVKHEKEEKKHSLLEKLHRSDSSSSSSSEEEGEDGEKRKKKKDKKKTATTAEGEVKTEEEKKGFMDKLKEKLPGHGKKPEDASPAAPVVAPPVEEAHPAEKKGILEKIKEKLPGYHPKTVDEVKKEKETD

SEQ ID NO: 5813 - protein, 194 aa, Unknown
  Sequence found in Organisms: Brassica napus, Brassica rapa
MAEETKNVVHEQEVPKVTTEESSAEVTDRGLFDFLGKKKEETKPEETIDSQFEHKVHISEPVVPEVKHEEEEKKHSLLEKLHRSDSSSSSSSEEEGEDGEKRKKKKDKKKTATTAEGEVKTEEEKKGFMDKLKEKLPGHGKKPEDASPAAPVVAPPVEEAHPAEKKGILEKIKEKLPGYHPKTVDEVKKEKETD

SEQ ID NO: 5814 - protein, 194 aa, Brassica juncea
MAEETKNVVHAQEVPKVTTEESSAEVTDRGLFDFLGKKKEETKPEETIDSQFEHKVHISEPVVPEVKHEEEEKKHSLLEKLHRSDSSSSSSSEEEGEDGEKRKKKKDKKKTATTAEGEVKTEEEKKGFMDKLKEKLPGHGKKPEDASPAAPVVAPPVEEAHPAEKKGILEKIKEKLPGYHPKTVDEVKKEKETD

SEQ ID NO: 5815 - protein, 194 aa, Brassica napus
MAEETKNVVHEQEVPKVTTEESSAEVTDRGLFDFLGKKKEETKPEETIDSEFEHKVHISEPVVPEVKHEKEEKNHSLLEKLHRSDSSSSSSSEEEGEDGEKRKKKKDKKKTATTAEGEVKTEEEKKGFMDKLKEKLPGHGKKPEDASPAAPVVAPPVKEAHPAEKKGILEKIKEKLPGYHPKTVDEVKKEKETD

SEQ ID NO: 5816 - protein, 193 aa, Raphanus sativus
MAEETKNVHEHEVPKVATEESSAATGEVTDRGMFDFLKKKKEETKPEETTHSEFEQKVQVSEPVPEVKHEEEEKKPSLLEKLHRSDSSSSSSSEEEGEDGEKRKKKKDKKKIATEGEGQTEEEKKGFMDKLKEKLPGHGKKPEDDSAAAAAPAVAPPVEEAHPAEKKGILEKIKEKLPGYHSKTVEEEKKDDH

SEQ ID NO: 5817 - protein, 201 aa, Thellungiella halophila
MAEETKNVHEQEVPRVATEESPAATAEVTDRGLFDFLGKKKEETKPEGTIDSEFEQKVQISEPAPEVKHEEEEKKPSLLEKLHRSDSSSSSSSEEEGEDGEKRKKKKKDKKKTTTTTTAEGEVKTEEEKKGFMEKLKEKLPGHGKKPEDASAAAPAAPVVVPPVEEAHPAEKKGILEKIKEKLPGYHPKTVEEEKKEKESG

SEQ ID NO: 5818 - protein, 194 aa, Unknown
  Sequence found in Organisms: Brassica napus, Brassica rapa
MAEETKNVHEQEVPKVVMEESSAATGEVTDRGMFDFLKKKKEETKPEETINSEFEQKVQVSEPVPEVKHEEAEKKPSLLEKLHRSDSSSSSSSEEEGEDGEKRKKKKKDKKKIATEGEVQTEEAKKGFMDKLKEKLPGHGKKPEDDSAVAAAPVVAPPVEEAHPAEKKGILEKIKEKLPGYHSKTVEEEKKDDH

SEQ ID NO: 5819 - protein, 197 aa, Brassica juncea
MAEETKNVVHEQEVPKVTTEESSAEVTDRGLFDFLGKKKEETKPEQTIDSEFEHKVHISEPVVPEVKHEEEEKKHSLLEKLHRSDSSSSSSSEEEGEDGVKRKKKKDKKKTTTTTVEGEVKTDEEKKGFMDKLKEKLPGHGKKPEDASPAAAAPVVAPPVEEAQPAEKKGILEKIKEKLPGYHPKTADEVKKEKESD

SEQ ID NO: 5820 - protein, 188 aa, Brassica juncea
KNVVHEQEVPKVTTEESSAEVTDRGLFDFLGKKKEETKPEETIDSQFEHKVHISEPVVPEVKHEEEEKKHSLLEKLHRSDSSSSSSSEEEGEDGVKRKKKKKDKKKIATEGEVQTEEAKKGFMDKLKEKLPGHGKKPEDDSAVAAAPVVAPPVEEAHPAEKKGILEKIKEKLPGYHSKTVEEEKKDDH

SEQ ID NO: 5821 - protein, 117 aa, Raphanus sativus
MAEETKNVVHEQDVPKVTTEESSADVTDRGLFDFLGKKKEETKPEGTIDSEFEHKVHISEPVVPEVKHEEEEKKHSLLEKLHRSDSSSSSSSEEEGEDGVKRKKKEGQEEDYYFYNC

SEQ ID NO: 5822 - protein, 199 aa, Raphanus sativus
MAEETKNVVHEQDVPKVTTEESSADVTDRGLFDFLGKKKEETKPEGTIDSEFEHKVHISEPVVPEVKHEEEEKKHSLLEKLHRSDSSSSSSSEEEGEDGVKRKKKKDKKKTTTSTTVEGEVKTDEEKKGFMDKLKEKLPGHGKKPEDASPAAAAAPVVAPPVEEAHPAEKKGILEKIKEKLPGYHPKTVDEVKKEKESD

SEQ ID NO: 5823 - protein, 200 aa, Raphanus sativus
MAEETKNVVHEQDVPKVTTEESSAEVTDRGLFDFLGKKKEETKPEETIDTEFEHKVHISEPVVVSEVKHEEEEKKHSLLEKLHRSDSSSSSSSEEEGEDGVKRKKKKDKKKTTTTTTVEGEVKTDEEKKGFMDKLKEKLPGHGKKPEDASPAAAAAPVVTPPVEEAHPAEKKGILEKIKEKLPGYHPKTVDEVKKEKESD

SEQ ID NO: 5824 - protein, 183 aa, Brassica napus
MAEETKKVHEVPKVATEESSAETGEVTDRGMFDFLKKKNEETKSEETINSEFEQKVQVSEPVPEVKHEEEEKKPSLLEKLHRNDSSSSSSSEEEGEDGEKRKKKKKDKKKIATEGEVQTEEEKKGFMDKLKEKLPGHGKKPEDDSTAVAAPVVAPPVEEAHPAEKKGILEKIKEKLPVPLKDR

SEQ ID NO: 5825 - protein, 211 aa, Brassica napus
QPYSHRPSDHSRCCQPCQTNPTTFMRMRPLSEPLSNHQRSRARLQAALPSTFWARRKMNATPEETIDSEFEQKVHISEPVPEVKHEEEKEEKKHSLLEKLHRSDSSSSSSSEEEGEDGVKRKKKKDKKKVTTTEGEVKTEEEKKGFMDKLKEKLPGHGKKPEEPSPAPVVAPPVEEAHPAEKKGILEKIKEKLPGYHPKTVEEEKKDKDDH

SEQ ID NO: 5826 - protein, 97 aa, Brassica rapa
MVKVMWGSSLALAAALLLVTVANIPVAEGVTCSPTELTSCSSAFMSASPPSATCCAKLREQKPCLCGYLRNPALSQYVNSPNAKKVASSCNVATPKC

SEQ ID NO: 5827 - protein, 97 aa, Brassica napus
MVKMMWGSSLALAAALLLVTVANIPVAEGVTCSPTELTSCSSAFMSASPPSATCCAKLREQNPCLCGYLRNPALSQYVNSPNAKKVASSCNVATPKC

SEQ ID NO: 5828 - protein, 97 aa, Unknown
  Sequence found in Organisms: Brassica napus, Zea mays
MVKVMWGSSLALAVALLLVTVANIPVAEGVTCSPTELTSCSPAFMSASPPSATCCAKLREQKPCLCGYLRNPTLSQYVNSPNAKKVASSCNVATPKC

SEQ ID NO: 5829 - protein, 97 aa, Brassica oleracea
MVKVMWGSSLALAVALLLVTVANIPVAEGVTCSPTELASCSPAFMSASPPSATCCAKLREQKPCLCGYLRNPTLSQYVNSPNAKKVASSCNVATPKC

SEQ ID NO: 5830 - protein, 97 aa, Brassica juncea
MVKVMWGSILALAAALLLVTVANIPVAEGVTCSPTELTSCSSAFMSSSPPSATCCAKLREQKPCLCGYLRNPTLRQYVNSPNAKKVASSCNVATPNC

SEQ ID NO: 5831 - protein, 97 aa, Raphanus sativus
MVKVMWGSILALAAALLLVTVENIPMAEGVTCSPTELTSCSSAFMSASPPSATCCAKLREQKPCLCGYLRNPALRQYVNSPNAKKVASSCNVATPNC

SEQ ID NO: 5832 - protein, 97 aa, Brassica juncea
MVKVMRGSILALAAVLLLVTVANIPVAEGVTCSPTELTSCSSAFMSASPPSATCCAKLREQKPCLCGYLRNPTLRQYVNSPNAKKVASSCNVATPNC

SEQ ID NO: 5833 - protein, 97 aa, Brassica juncea
MVKVMRGSILALAAVLLLVTVANIPVAEGVTCSPTELTSCSSAFMSASPPSATCCAKLREQKPCLCGYLRNPTLRQYVNSPNAKKVASSCNVVTTNC

SEQ ID NO: 5834 - protein, 89 aa, Brassica juncea
ILALAAVLLLVTVANIPVAEGVTCSPTELTSCSSAFMSASPPSATCCAKLREQKPCLCGYLRNPTLRQYVNSPNAKKVASSCNVVTTNC

SEQ ID NO: 5835 - protein, 151 aa, Zea mays
MQYYETRAKEYYDVAQGQSRQSYGQNHQGYGQSQSRPVYGHSPTLNYRSHGGFLDGLFKGKNGQKGQNGLGSFIGKHKNQDTNKDHEHGKLLGQHEKKTQETNKGVNGLGMFINCGEKKLKKQNEHKKKKKNKDGHASGNESGSSSGSDSD

SEQ ID NO: 5836 - protein, 150 aa, Brassica napus
MQYYETREKEYYDVAQGQSRQSYGQNHQGYGQSQSRPVYGNSPTLNYRSHGGFLDGLFKGKNGQKGQNGLGSFLGQHKNQDTNQGHGHGKLLGQHQKKTHETNKGVNGLGMFINNGEKKHKKQNEHKKKKNKDGHASGNESGSSSGSDSE

SEQ ID NO: 5837 - protein, 165 aa, Brassica rapa
THNTNIIIKLTSSQMQYYETRAKEYYDVAQGQSRQSYGQNHQGYGQSQSRPVYGHSPTLNYRSHGGFLDGLFKGKNGQKGQNGLGSFIGKHKNQDTNKDHEHGKLLGQHEKKTQETNKGVNGLGMFINCGEKKLKKQNEHKKKKKNKDGHASGNESGSSSGSDSD

SEQ ID NO: 5838 - protein, 168 aa, Brassica napus
SRVDPASDIIIKLTSSQMQYYETRAKEYYDVAQGQSRQSYGQNHQGYGQSQSRPVYGHSPTLNYRSHGGFLDGLFKGKNGQKGQNGLGSFIGKHKNQDTNKDHEHGKLLGQHEKKTQETNKGVNGLGMFINCGEKKLKKQNEHKKKKKNKDGHASGNESGSSSGSDSD

SEQ ID NO: 5839 - protein, 159 aa, Brassica napus
IIIKLTSSQMQYYETREKEYYDVAQGQSRQSYGQNHQGYGQSQSRPVYGNSPTLNYRSHGGFLDGLFKGKNGQKGQNGLGSFLGQHKNQDTNQGHGHGKLLGQHQKKTHETNKGVNGLGMFINNGEKKHKKQNEHKKKKNKDGHASGNESGSSSGSDSE

SEQ ID NO: 5840 - protein, 166 aa, Brassica juncea
  misc_feature (162)..(162): Xaa can be any naturally occurring amino acid
THNTNTNHKTRFFSTTMQYYETREKEYYDVAQGQSRQGYGQNHHQGYDQSHSRPVYGHSPTMNHRSHGGFLDGLFKGKNGQKGQNGLGTFLEHKSHEANKGHGHGKLLGQHQKKTHETNKGVNGLGTFINNGEKKHKKQNEHKKKKNKDGHGSGNESGSSSXSDSD

SEQ ID NO: 5841 - protein, 137 aa, Brassica rapa
MIRSALGEFLNGDFSEKQGRSPASKSSVESLPRVVIGKDEERRGSCPICLDEWSEGDVAAEMPCKHRFHSKCVEEWLGRQATCPLCRYEMPVEEVEEEKKVGVWIGFSVGAGGRRNGEEDGGGRSEGGSNTRDETEA

SEQ ID NO: 5842 - protein, 165 aa, Brassica napus
HNTNTNHKTRFFSTTMQYYETREKEYYDVAQGQSRQGYGQNHHQGYDQSHSRPVYGHSPTMNHRSHGGFLDGLFKGKNGQKGQNGLGTFLEHKSHEANKGHGHGKLLGQHQKNTHETNKGVNGLGTFINNGEKKHKKQNEHKKKKNKDGHGSGNESGSSSGSDSD

SEQ ID NO: 5843 - protein, 150 aa, Brassica juncea
MQYYETREKEYYDVAQGQSRQGYGQNHHQGYDQSHSRPVYGHSPTMNHRSHGGFLDGLFKGKNGQKGQNGLGTFLEHKSHEANKGHGHGKLLGQHQKKTHETNKGVNGLGTFINNGEKKHKKQNEHKKKKNKDGHGSGNESGSSSDSDSD

SEQ ID NO: 5844 - protein, 164 aa, Brassica oleracea
DAWANIIIKLTSSQMQYYETREKEYYDVAQGQSGQSYGQNHQGYGQSQSRPVYGHSPTLNYRSHGGFLDGLFKGKNGQKGQNGLGSFLGQHKNQDTNKGHGHGKLLGQHQKKTHDTNKGVKGLGMFINNGEKKHKKQNEHKKKKNKDGHASGNESGSSSGSDSD

SEQ ID NO: 5845 - protein, 162 aa, Raphanus sativus
ATHNTNRRTHCFYTTQMQYYATREKEYYDVAQGQSRQSNSQNHQGYDQSQSRPVYGHSPTLNYRSHGGFLDGLFKGRNGQKGQNGLGSFLGKHKSQEANKGHGHGKLLGQHQKTTHETNKGINGLGLFINNGEKKHKKQNEEKKKKNKDGHESGSSSGSDSD

SEQ ID NO: 5846 - protein, 149 aa, Raphanus sativus
MQYYETRGKEYYDVAQAQSRQANGQNHHQGYGQSQTRPVYGKSPTLNYRSHGGFLDGLFKGKNAQKDQNGLGTFLGHKSQEANKGHGHGKLLGQHQKKTHETNKGDYGLGTFINNGEKKHKKQNEHKKKKKDGHGSGNESGSSSGSDSD

SEQ ID NO: 5847 - protein, 150 aa, Raphanus sativus
MQYYETRGKEYYDVAQAQSRQANGQNHHQGYGQSQNRPVYGKSPTLNYRSHGGFLDGLFKGKNAQKDQNGLGTFLGHKSQEANKGHGHGKLLGQHQKKAHETNKGDYGLGTFINNGEKKHKKQNEHKKKKNKDGHGSGNESGSSSGSDSD

SEQ ID NO: 5848 - protein, 54 aa, Brassica oleracea
  misc_feature (4)..(4): Xaa can be any naturally occurring amino acid
  misc_feature (8)..(8): Xaa can be any naturally occurring amino acid
  misc_feature (36)..(38): Xaa can be any naturally occurring amino acid
HKTXFFSXMMQYYETREKEYYDVAQGQSRQVYGQNXXXDMTRAIPAQYMGIVRL

SEQ ID NO: 5849 - protein, 184 aa, Brassica napus
GQSDLRAGPKITSRNKPLIPPPHNTNTNHKTRFFSTMMQYYETREKEYYDVAQGKSRQGYGQNHHQGYDQSHTRPVYGHSPTMNHRSHGGFLDGLFKSKNGQNGLGTFLEHKSHEANKGHGHGKLLGQHQKKTHETDKGVNGLGTFINNGEKKHKKQNEHKKKKNKDGHGSGNESGSSSGSDSD

SEQ ID NO: 5850 - protein, 162 aa, Raphanus sativus
  misc_feature (74)..(74): Xaa can be any naturally occurring amino acid
THTTNHRTRCFYTTKMQYYGTHEKEYYDVAHGQSRQSNSQNHQGYDQSQSRPVYGHSPTLNYRSHGGFLDGLFXGRNGQKGQNGLGSFLGKHKSQEANKGHGHGKLLGQHQKTNHETNKVTNGLGLFINNGEKKHKKQNEEKKKKKNKDGHESGSSSGSDSD

SEQ ID NO: 5851 - protein, 147 aa, Brassica napus
MQYYETREKEYYDVAQGKSRQGYGQNHHQGYDQSHTRPVYGHSPTMNHRSHGGFLDGLFKSKNGQNGLGTFLEHKSHEANKGHGHGKLLGQHQKKTHETDKGVNGLGTFINNGEKKHKKQNEHKKKKNKDGHGSGNESGSSSGSDSD

SEQ ID NO: 5852 - protein, 169 aa, Brassica napus
MGLVTEEVRAKAEKYTGDEICREKTKVFLKEISMPNGLLPLKDIEEVGYDRESGVVWLKQKQSITHKFETIDKLVSYGTEVTAVVQTGKIKKLTGVKAKELLIWVSVSEIYTEEKEKITFKTPTTLSRTFPVSAFVVPEEVEPAKEEPAKEKSSEAAAEVKEAVAVKEA

SEQ ID NO: 5853 - protein, 169 aa, Brassica rapa
MGLVTEEVRAKAEKYTGDEICREKTKVFLKEISMPNGLLPLKDIEEVGYDRESGVVWLKQKQSITHKFETIDKLVSYGTEVTAVVQTGKIKKLTGVKAKELLIWVSVSEIYTEEKEKITFKSPTTLSRTFPVSAFVVPEEVEPAKEEPVKEKSSEAAAEVKEAVAVKEA

SEQ ID NO: 5854 - protein, 168 aa, Unknown
  Sequence found in Organisms: Brassica napus, Zea mays, Brassica juncea, Brassica oleracea
MGLVTEEVRAKAEKYTGDEICREKTKVFLKEISMPNGLLPLKDIEEVGYDRESGVVWLKQKQSITHKFETIDKLVSYGTEVTAVVQTGKIKKLTGVKAKELLIWVSVSEIYTEEKEKITFKSPTTLSRTFPVPAFIVPEEVEPAKEEPVKEKSSEAAEVTEAVAVKEA

SEQ ID NO: 5855 - protein, 176 aa, Brassica napus
MGLVTEEVRAKAEKYTGDEICREKTKVFLKEISMPNGLLPLKDIEEVGYDRESGVVWLKQKQSITHKFETIDKLVSYGTEVTAVVQTGKIKKLTGVKAKELLIWVSVSEIYTEEKEKITFKSPTTLSRTFPVSAFVVPEEVEPAKEEPAKEKSSEAAAEVKEAVAVKEAQSKLFYS

SEQ ID NO: 5856 - protein, 168 aa, Brassica juncea
MGLVTEEVRAKAEMYTGDEICREKTKCFLEEISMPNGLLPLKDIEEVGYDRESGVVWLKQKQSITHKFEKIDKLVSYGTEVTAIVQTGKIKKLTGVKAKELLIWVSISEIYTEEKEKITFKSPTTLSRTFPVSAFVVPEEVKPAKEEPVKEKSSEAAEVKEAVAVKEA

SEQ ID NO: 5857 - protein, 168 aa, Brassica juncea
MGLVTEEVRAKAEMYTGDEICREKTKCFLEEISMPNGLLPLKDIEEVGYDRESGVVWLKQKQSITHKFEKIDKLVSYGTEVTAVVQTGKIKKLTGVKAKELLIWVSVSEIYTEEKEKITFKSPTTLSRTFPVSAFIVPEEVEPVKEEPVKEKSSEATEVKEAVAVKEA

SEQ ID NO: 5858 - protein, 168 aa, Brassica juncea
MGLVTEEVRAKAEMYTGDEICREKTKCFLEEISMPNGLLPLKDIEEVGYDRESGVVWLKQKKSITHKFENIDKLVSYGTEVTAVVQTGKIKKLTGVKAKELLIWVSISEIYTEEKEKITFKSPTTLSRTFPVSAFVVPEEVKPAKEEPVKEKSSEAAEAKETVAVKEA

SEQ ID NO: 5859 - protein, 168 aa, Raphanus sativus
MGLVTEEVRAKAEMYTGDEICREKTKCFLEEISMPNGLLPLKDIEEVGYDRESGVVWLKQKQSITHKFEKIDKLVSYGTEVTAVVQTGKIKKLTGVKAKELLIWVSISDIYTDDKEKITFKSPTTLSRTFPVSAFVVPEEVEPAKEEPLKEKISEAAEVKEAVAVKEA

SEQ ID NO: 5860 - protein, 168 aa, Raphanus sativus
MGLVTEEVRAKAEMYTGDEICREKTKCFLDEISMPNGLLPLKDIEEVGYDRESGVVWLKQKQSITHKFEKIDKLVSYGTEVTAVVQTGKIKKLTGVKAKELLIWVSISDIYTDDKEKITFKSPTTLSRTFPVSAFVVPEEVEPAKEEPLKEKISEAAEVKEAVAVKET

SEQ ID NO: 5861 - protein, 168 aa, Raphanus sativus
  misc_feature (22)..(22): Xaa can be any naturally occurring amino acid
MGLVTEEVRAKAEMYTGDEICXEKTKCFLEEISMPNGLLPLKDIEEVGYDRESGVVWLKQKQSITHKFEKIDKLVSYGTEVTAVVQTGKIKKLTGVKAKELLIWVSISDIYTDDKEKITFKSPTTLSRTFPVSAFVVPEEVEPAKEEALKEKSSEAAEVKEAVAVKEA

SEQ ID NO: 5862 - protein, 163 aa, Brassica nigra
EEVRAKAEMYTGDEICREKTKCFLEEISMPNGLLPLKDIEEVGYDRESGVVWLKQKKSITHKFENIDKLVSYGTEVTAVVQTGKIKKLTGVKAKELLIWVPISEIYTEEKEKITFKSPTTLSRTFPVSAFVVPEEVKPAKEEPVKEKSSEAAEIKEAVAVKEA

SEQ ID NO: 5863 - protein, 175 aa, Thellungiella halophila
MGLVTEEVRAKAEMYTGDEICREKTKVFLKEISMPNGLLPLKDIEEVGYDRESGVVWLKQKHSITHKFQEIDKLVSYGTEVTAVVETGKIKKLTGVKAKELLIWVTVNEIFTEDKGKITFKTPTTLSRTFPVSAFIVPEEVEPAKEEPAKEKTSSEATEVKEAVAVKETVAVKEA

SEQ ID NO: 5864 - protein, 179 aa, Brassica juncea
MGLVTEEVRAKAEMYTGDEICREKTKVFLKEIAMPNGLLPLKDIEEVGYDRESGVVWLKQKQSITHKFEEIDKLVSYGTEVSAVVQTGKIKKLTGVKSKELLIWVSISEIYTEEKEKITFKSPTTLSRTFPVSAFIVPEEAEPAKVKSSEATEEAAKEEPAKEAAKEEPAKEAVAVKEA

SEQ ID NO: 5865 - protein, 184 aa, Unknown
  Sequence found in Organisms: Brassica napus, Brassica rapa
MGLVTEEVRAKAEMYTGDEICREKTKCFLKEISMPNGLLPLKDIEEAGYDRESGVVWLKQKQSITHKFENIDKLVSYGTEVTAVVKTGKIKKLTGVKAKELLIWVSVSEIYTEEKEKITFKSPTTLSRTFPVSAFIVPEEVEPAKEEPAKEKSSEATEEVTEEEPAKEAAKVEPAKEAVAVKEA

SEQ ID NO: 5866 - protein, 157 aa, Raphanus sativus
  misc_feature (39)..(39): Xaa can be any naturally occurring amino acid
  misc_feature (95)..(95): Xaa can be any naturally occurring amino acid
  misc_feature (138)..(138): Xaa can be any naturally occurring amino acid
  misc_feature (157)..(157): Xaa can be any naturally occurring amino acid
KAEMYGDEICREKTKCFLDEIFMPNGLLPLKDIEEVGYXRESGVVWLKQKQSITHKFEKIDKLVSYGTEVTAVVQTGKIKKLTGVKAKELFIWVXISDIYTDDKEKITFKSPTTLFRTFPVSAFVVPEEVEPAKEEPXKEKISEAAEVKEAVAVKEX

SEQ ID NO: 5867 - protein, 179 aa, Arabidopsis thaliana
MGLVTEEVRAKAEMYTGDEICREKTKCFLKEISMPNGLLPLKDIEEVGYDRESGVVWLKQKKSITHKFTEIDKLVSYGTEVTAIVETGKIKKLTGVKAKELLIWVTINEIYTEEPPTKITFKTPTTLSRTFPVTAFIVPEEPAKEEPAKEEPAKEKSSEATEAKEAVAIKEAVAVKEAA

SEQ ID NO: 5868 - protein, 149 aa, Raphanus sativus
ICREKTKCFLEEISMPNGLLPLKDIEEVGYDRESGVVWLKQKQSITHKFEKIDKLVSYGTEVTAVVQTGKIKKLTGVKAKELLIWVSISDIYTDDKEKITFKSPTTLSRTFPVSAFVVPEEVEPAKEEPLKEKISEAAEVKEAVAVKEA

SEQ ID NO: 5869 - protein, 180 aa, Arabidopsis lyrata
MGLVTEEVRAKAEMYTGDEICREKTKCFLKEISMPNGLLPLKDIEEVGYDRESGVVWLKQKKSITHKFTEIDKLVSYGTEVTAIVETGKIKKLTGVKAKELLIWVTINEIYTEEPPTKITFKTPTTLSRTFPVTAFTVPEEEPAKEEPAKEEPAKEKSSEATEAKEAVAIKEAVAVKEAA

SEQ ID NO: 5870 - protein, 168 aa, Raphanus sativus
MGLVTEEIRAKAEKYTGEICQEKAKVFYKEISMPSGLLPLKDIEEVGYDRESGVVWLKQKESIIHKFEEIDKLVSYGTEITAVVETGRIKKLTGVKAKELLIWITVNEIYTQDGGKITFKTPTTLSRTFPVSAFTVPEEVEPAKEKGSEATEVKEAVAIKEAVPVKEA

SEQ ID NO: 5871 - protein, 179 aa, Brassica napus
EEVRAKAEMYTGDEICREKTKCFLKEISMPNGLLPLKDIEEAGYDRESGVVWLKQKQSITHKFENIDKLVSYGTEVTAVVKTGKIKKLTGVKAKELLIWVSVSEIYTEEKEKITFKSPTTLSRTFPVSAFIVPEEVEPAKEEPAKEKSSEATEEVTEEEPAKEAAKVEPAKEAVAVKEA

SEQ ID NO: 5872 - protein, 184 aa, Raphanus sativus
MGLVTEEVRAKAEMYTGDEMCREKIKVFLKEISMPNGLLPLKDIEEVGYDRESGVVWLKQKQSITHKFEAIDKLVSYGTEVTAVVQTGKIKKLTGVKSKELLIWVTISEIYTEEKEKITFMSPTTLSRTFPVSAFIVPEEVEPAKEEPAKEKSSEATEEAAKEEPAKEAAKEEPAKEAVAVKEA

SEQ ID NO: 5873 - protein, 184 aa, Raphanus sativus
MGLVTEEVRAKAEMYTGDEMCQEKIKVFLKEISMPNGLLPLKDIEEVGYDRESGVVWLKQKQSITHKFEAIDKLVSYGTEVTAVVQTGKIKKLTGVKSKELLIWVTISEIYTEEKEKITFMSPTTLSRTFPVSAFIVPEEVEPAKEEPAKEKSSEATEEAAKEEHTKEAAKEEPAKEAVSVKEA

SEQ ID NO: 5874 - protein, 184 aa, Raphanus sativus
MGLVTEEVRAKAEMYTGDEMCQEKIKVFLKEISMPNGLLPLKDIEEVGYDRESGVVWLKQKQSITHKFEAIDKLVSYGTEVTAVVQTGKIKKLTGVKSKELLIWVTISEIYTEEKEKITFMSPTTLSRTFPVSAFVVPEEVEPAKEEPAKEKSSEATKLKAKGEPAKEAAKEEPAKEAVAVKDA

SEQ ID NO: 5875 - protein, 184 aa, Raphanus sativus
MGLVTEEVRAKAEMYTGDEMCREKIKVFLKEISMPNGLLPLKDIEEVGYDRESGVVWLKQKQSITHKFEAIDKLVSYGTEVTAVVQTGKIKKLTGVKSKELLIWVTISEIYTEEKEKITFMSPTTLSRTFPVSAFIVPDEVEPAKEEPAKEKSSEATEEAAKEEPTKEAAKEEPAKEAVAVKEA

SEQ ID NO: 5876 - protein, 184 aa, Raphanus sativus
MGPVTEEVRAKAEMYTGDEMCQEKIKVFLKEISMPNGLLPLKDIEEVGYDRESGVVWLKQKQSTTHKFEAIDKLVSYGTEVTAVVQTGKIKKLTGVKSKELLIWVTISEIYTEEKEKITFMSPTTLSRTFPVSAFIVPEEVEPAKEEPAKEKSSEATEEAAKEEPAKEAAKEEPAKEAVAVKEA

SEQ ID NO: 5877 - protein, 179 aa, Unknown
  Sequence found in Organisms: Brassica napus, Brassica rapa
MANLSTLVGCIAIIFFTVVAPASSATHSVEWSLGKDYSSLATGKPYAIGDTIVFNYGAGHTVDEVSESDYKSCTLGNSISSDSSGTTSIALKTAGSHYFICAIPGHCAGGMKLSVNVGAAASSDGGGDTGDGTTPKTTPSPTVEGRKAAPSASATAMLKPFKALVVTCVAALLYALALS

SEQ ID NO: 5878 - protein, 179 aa, Brassica napus
MANLSTLVGCIAIIFFTVVAPASSATHSVEWSLGKDYSSLATGKPYAIGDTIVFNYGAGHTVDEVSESDYKSCTLGNSISSDSSGTTSIALKTAGSHYFICAIPGHCAGGMKLSVYVGAEASSDGGGDSGDGTTPKTTPSPTVEGRKAAPSASATAMLKPFKALVLTCVAALLYALALS

SEQ ID NO: 5879 - protein, 179 aa, Brassica juncea
MANLSILVGCLAIIFFTVVAPASSATHSVEWSLGKDYSSLATGKPYAIGDTIVFNYGAGHTVDEVSESDYKSCTLGNSISSDSSGTTSIALKTAGSHYFICAIPGHCAGGMKLSVNVGAAASSDGGGDSGGTTTPKTTPSPTSESRKAAPTASDTAVLKPFKALVVTCVVVLLYALALS

SEQ ID NO: 5880 - protein, 180 aa, Brassica juncea
MANLSTLVGCIAIIFFTVVAPASSATHSVEWSLGKDYSSLATGKPYAIGDTIVFNYGAGHTVDEVSESDYKSCTLGNSISSDSSGTTSIALKTAGSHYFICAIPGHCVGGMKLSVNVGGAAASSDGGGDSGGTTTPKTTPSPTSESRKAAPTASDTAVLKPFKALVVTCVVVLLYALALS

SEQ ID NO: 5881 - protein, 179 aa, Raphanus sativus
MANLSTLVGCLAIIFFTVAAPASSATHSVEWSLGEDYSSLATGKPYAIGDTIVFNYGAGHTVDEVSESDYKSCTLGNSISSDSSGTTSIALKTAGSHYFICAIPGHCTGGMKLSVNVGAASSSDGGSDSGGSTTPKTTPSPTTESRKAAPTASATAVLEPFKALVVTCVVVLLYALVLS

SEQ ID NO: 5882 - protein, 176 aa, Brassica juncea
MANLSTLVGCLAIIFFTSVAPASSATHSVEWSLGNDYSSLATGKPYAVGDTIVFNYGAGHTVDEVSESDYKSCTLGNSISSDSSGTTSIALKTSGSHYFICAIPGHCTGGMKLSVNVGAATSSGGGGDGATAKTTPSPTLEGGKAAPTASATPVLKPFQALVVTCVVALLYALALS

SEQ ID NO: 5883 - protein, 176 aa, Brassica juncea
MANLSTLVGCLAIIFFTSVAPASSATHSVEWSLGNDYSSLATGKPYAVGDTIVFNYGAGHTVDEVSESDYKSCTLGNSISSDSSGTTSIALKTSGSHYFICAIPGHCTGGMKLSVNVGAAASSGGGGVGATAKTTPSPTVEGGKSAPTASATAVLKPFEAVVMTCVVALLYTLALS

SEQ ID NO: 5884 - protein, 177 aa, Brassica napus
MANLSTLVVYLAIVFFTAAVTPASSATHSVEWSLGNDYSSLATGKPYAVGDTIVFNYGAGHTVDEVSESDYKSCTLGNSISSDSSGTTSIALKTSGSHYFICAIPGHCTGGMKLSVNVGAATSSGGGGDGATAKTTPSPTLEGGKAAPTASATPVLKPFQALVVTCVVALLYALALS

SEQ ID NO: 5885 - protein, 177 aa, Brassica rapa
MANLSTLVVYLAIVFFTASVTPASSATHSVEWSLGNDYSSLATGKPYAVGDTIVFNYGAGHTVDEVSESDYKSCTLGNSISSDSSGTTSIALKTSGSHYFICAIPGHCTGGMKLSVNVGAATSSGGGGDGATAKTTPSPTLEGGKAAPTASATPVLKPFQALIVTCVVALLYALALS

SEQ ID NO: 5886 - protein, 177 aa, Brassica napus
  misc_feature (4)..(4): Xaa can be any naturally occurring amino acid
  misc_feature (9)..(10): Xaa can be any naturally occurring amino acid
  misc_feature (21)..(21): Xaa can be any naturally occurring amino acid
MANXSTLVXXLAIVFFTAAVXPASSATHSVEWSLGNDYSSLATGKPYAVGDTIVFNYGAGHTVDEVSESDYKSCTLGNSISSDSSGTTSIALKTSGSHYFICAIPGHCTGGMKLSVNVGAATSSGGGGDGATAKTTPSPTLEGGKAAPTASATPVLKPFQALVVTCVVALLYALALS

SEQ ID NO: 5887 - protein, 176 aa, Raphanus sativus
MTNSSALVGCLAIFFFTYVAPASSATHSVEWSLGNDYSSLATGKPYAVGDTIVFNYGAGHTVDEVRESDYKSCTLGNSISSDSSGTTSIALKTSGSHYFICAIPGHCSGGMKLSVNVGAAVSSGGGGDGATAKTTPSPTLEGGKAAPTASATAVMKPFEALVVTCVVAVLYALALS

SEQ ID NO: 5888 - protein, 177 aa, Brassica juncea
MANLSTLVVYLAIVFFTAAVTPASSATHSVEWSLGNDYSSLATGKPYAVGDTIVFNYGAGHTVDEVSESDYKSCTLGNSISSDSSGTTSIALKTSGSHYFICAIPGHCTGGMKLSVNVGAAASSGGGGVGATAKTTPSPTVEGGKSAPTASATAVLKPFEAVVMTCVVALLYTLALS

SEQ ID NO: 5889 - protein, 66 aa, Raphanus sativus
MKLSVNVGAVVSSGGGGDGATAKTTPSPTLEGGKAAPTASAPAVMKPFEALVVTCVVALLYALALS

SEQ ID NO: 5890 - protein, 154 aa, Brassica juncea
THSVEWSPGKDNSSLATGKPYAIGDTIVFNYGAGHTVDEVSESDYKSCTLGNSISSDSSGTTSIALKTAGSHYFICAIPGHCAGGMKLSVNVGAAASSDGGGDSGDGNTPKTTPSPTVEGRKAAPSASATAMLKPFKALVVTCVAALLYALALS

SEQ ID NO: 5891 - protein, 319 aa, Brassica rapa
MGFLGKSVLVSLIALWCFTSSAFTEEVNHVTQTPSSAPAPAPYHHGHHHPHPPHPHHPHPHPPAKAPVKPPVSPPAKPPVKPPVYPPAKAPVKPPTKPPVKPPVSPPAKPPVKPPVYPPTKAPVKPPVKPPVKPPVSPPAKPPVKPPVYPPTKAPTKPPTKPPVKPPVSPPAKPPVKPPVYPPKFNRSLVAVQGTVFCKSCKYASYDSLTGAKPVEGAKVRLVCKSKKNIVAETETDKNGYFLLLAPKTVTNFGFRGCRAYLVKSKDYKCNKVSKLFGGDVGAVLKPVKTPGKSSVVINKLTYGVFNVGPFAFDPVCPK

SEQ ID NO: 5892 - protein, 319 aa, Brassica napus
MGFLGKSVLVSLIALWCFTSSAFTEEVNHVTQTPSSAPAPAPYHHGHHHPHPPHPHHPHPHPPAKAPVKPPVSPPAKPPVKPPVYPSAKAPVKPPTKPPVKPPVSPPAKPPVKPPVYPPTKAPVKPPVKPPVKPPVSPPAKPPVKPPVYPPTKAPTKPPTKPPVKPPVSPPAKPPVKPPVYPPKFNRSLVAVQGTVFCKSCKYASYDSLTGAKPVEGAKVRLVCKSKKNIVAETETDKNGYFLLLAPKTVTNFGFRGCRAYLVKSKDYKCNKVSKLFGGDVGAVLKPVKTRGKSSVVINKLTYGVFNVGPFAFDPVCPK

SEQ ID NO: 5893 - protein, 315 aa, Brassica napus
  misc_feature (68)..(68): Xaa can be any naturally occurring amino acid
MGFLGKSVLVSLIALWCFTSSAFTEEVNHVTQTPSSAPAPAPYHHGHHHPHPPHPHHPHPHPPAKAPXKPPVSPPAKPPVYPSAKAPVKPPTKPPVKPPVSPPAKPPVKPPVYPPTKAPVKPPVKPPVKPPVSPPAKPPVKPPVYPPTKAPTKPPTKPPVKPPVSPPAKPPVKPPVYPPKFNRSLVAVQGTVFCKSCKYASYDSLTGAKPVEGAKVRLVCKSKKNIVAETETDKNGYFLLLAPKTVTNFGFRGCRAYLVKSKDYKCNKVSKLFGGDVGAVLKPVKTRGKSSVVINKLTYGVFNVGPFAFDPVCPK

SEQ ID NO: 5894 - protein, 301 aa, Brassica napus
MGFLGKSVLVCLIALWCFTSSAFTEEVNHVTQTPSSAPAPAPYHHGHHHHHPHPPHPHHPHPHPPAKAPVKPPVSSPTKTPVKPPVYPPAKAPVKPPTKPPVKPPVSPPAKPPVKPPVYPPTKAPVKPPVYPPTKAPTKPPTKPPVKPPVSPPAKPPVKPPVYPPKFNRSLVAVQGTVFCKSCKYASYDSLTGAKPVEGAKVRLVCKSKKNIVAETETDKNGYFMLLAPKTVTNFGFRRCRAYLVKSKDYKCNKVSKLFGGDVGAVLKPVKTPGKSSVVINKLTYGVFNVGPFAFDPVCSK

SEQ ID NO: 5895 - protein, 315 aa, Brassica napus
MGFLGKSILSSLLAIWFFTSCAFTEEVNHVNQTPSSAPAPSPYHHGHHHPHPPHHHHPHPHPPAKAPVKPPVSPPSKPPVKPPVYPPTKSPVKPPTKPPVKAPVSPPAKPPVKPPVYPPTKAPVKPPVKPPVKPPVSPPAKPPVKPPTKAPVKPPVSPPTKPPVSPPAKPPVRPPVYPPKFNRSLIAVQGTVFCKSCQYASSDSLIGAKPVEGAVVRLLCKSKKNVVAETKTDKNGYFLLLGPKTVTNYGFRGCRVYLVKSKDYKCNKVSKLFRGDVGAVLKPEKRKGKSAVVINQLIYGIFNVGPFAFDPVCPK

SEQ ID NO: 5896 - protein, 301 aa, Brassica napus
MGFLGKSVLVCLIALWCFTSSAFTEEVNHVTQTPSSAPAPAPYHHGHHHHHPHPPHPHHPHPHPPAKAPVKPPVYPPTKTPAKPPANPPAKAPVKPPTKPPVKPPVYPPAKPTGKPPVYPPTKAPVKPPVYPPTKAPTKPPTKPPVKPPVSPPAKPPVKPPVYPPKFNRSLVAVQGTVFCKSCKYASYDSLTGAKPVEGAKVRLVCKSKKNIVAETETDKNGYFMLLAPKTVTNFGFRRCRAYLVKSKDYKCNKVSKLFGGDVGAVLKPVKTPGKSSVVINKLTYGVFNVGPFAFDPVCSK

SEQ ID NO: 5897 - protein, 313 aa, Thellungiella halophila
MGFLGKSVLVSLIALWCFTSSAFTEEVNHVTQTPSSAPAPAPYHHGHHHPHPPHHHHPHPHPHPPAKAPIPPPAKPPVKPPTKAPVKPPVKPPVKPPAKAPVYPPTKAPVKPPVKPPVMPPVSPPAKPPVKPPVYPPTKAPVKPPTKAPVKPPVSPPTKPPVSPPAKPPVMPPVYPPKFNRSLVAVRGTVYCKSCKYAYADTLNDAKPVKGAVVRLVCKSKKKIVAETTTDMNGYFWLLAPKTVTNYGFRGCRVYLVKSNDKKCNKVSKLFGGDVGAELKPEKRPGKSSVVINKFTYGIFNVGPFAFDPVCPK

SEQ ID NO: 5898 - protein, 348 aa, Brassica napus
DHKAKYERNMGFLGKSILSSLLAIWFFTSCAFTEEVNHVNQTPSSAPAPSPYHHGHHHPHPPHHHHPHPHPPAKAPVKPPVSPPSKPPVKPPVYPPTKSPVKPPTKPPVKPPVSPPAKPPVKPPVYPPTKAPVKPPVKPPVKPPVSPPAKPPIKPPVSPPAKPPVKPPVYPPTKAPVKPPTKAPAKPPVSPPAKPPVSPPAKPPVKPPVYPPKFNRSLIAVQGTVFCKSCQYASFDSLIGAKPVEGALVRLLCKSKKNIVAETKTDKNGYFLLLGPKTVTNYGFRGCRVYLVKSKDYKCNKVSKLFGGDVGAVLKPEKRKGKSAVVINQLIYGIFNVGPFAFDPVCPK

SEQ ID NO: 5899 - protein, 339 aa, Arabidopsis lyrata
MGFIGKSVLVSLVALWCFTSSVFTEEVNHVTQTPSLAPAPAPYHHGHHHPHPPHHHHPHPHPHPHPPAKSPVKPPVKAPVSPPAKPPVKPPVYPPTKAPVKPPTKPPVKPPVSPPAKPPVKPPVYPPTKAPVKPPTKPPVKPPVYPPTKAPVKPPTKPPVKPPVSPPAKPPVKPPVYPPTKAPVKPPVSPPTKPPVTPPVYPPKFNRSLVAVRGTVYCKSCKYAAFNTLLGAKPIEGATVKLVCKSKKNITAETLTDKNGYFLLLAPKTVTNFGFRGCRVYLVKSKDYKCSKVSKLFGGDVGAELKPERRPGKGTVVVNKLTYGLFNVGPFAFNPTCPK

SEQ ID NO: 5900 - protein, 220 aa, Thellungiella halophila
MGSEGPTAVTINITGFKKFHGVAENPTEKMATNLKEYLAKNSQSKDMVLGSCTVLETAGQGALASLYQLLQSAVNTKESESLTSGKTIWVHFGVNSGATKFAIEQQAVNEATFRCPDELGWRPQNLPIVPSDGPISTVRKTTLPVEEITKALEKKGFEVITSDDAGRFVCNYVYYHSLRFAEQNKTSSLFVHVPLFVAVNEETQMRFTASLLEVLASICN

SEQ ID NO: 5901 - protein, 219 aa, Arabidopsis thaliana
MGSEGPTGVTIHITGFKKFHGVAENPTEKMANNLKEYLAKNCVSKDVNLGSCTVLETAGQGALASLYQLLQSAVNTKESESLTGKTIWVHFGVNSGATKFAIEQQAVNEATFRCPDELGWKPQNLPIVPSDGPISTVRKTNLPVEEITKALEKNGFEVITSDDAGRFVCNYVYYHSLRFAEQNKTRSLFVHVPLFVAVDEETQMRFTVSLLEVLASICK

SEQ ID NO: 5902 - protein, 950 aa, Arabidopsis lyrata
MKSLKLILHRAYSTSTGVNNSFEISRLSRIGQINEARKFFDSLRYKAIGSWNSIVSGYFANGLPREARQMFDEMPERNIVSWNGLVSGYIKNRMIEEARNVFEIMPERNVVSWTAMVKGYVQEGMVVEAELLFWRMPERNEVSWTVMFGGLIDGGRIDDARKLYDMMPGKDVVASTNMIGGLCREGRVDEAREIFDEMRERNVITWTTMITGYGQNKRVDVARKLFEVMPEKTEVSWTSMLLGYTLSGRIEDAEEFFEVMPMKPVIACNAMIVALGEVGEIVKARRVFDQMEDRDNATWRGMIKAYERKGFELEALELFAQMQRQGVRPSFPSLISILSVCATLASLQYGRQVHAHLVRCQFDGDVYVASVLMTMYVKCGELVKAKLVFDRFPSKDIIMWNSIISGYASHGLGEEALKVFHEMPLSGTMPNKVTLIAILTACSYGGKLEEGLEIFESMESKFCVTPTVEHYSCTVDMLGRAGKVDKAMELINSMTIKPDATVWGALLGACKTHSRLDLAEVAAKKLFEIEPENAGPYILLSSINASRSKWGDVAEMRKNMRTKNVSKFPGCSWIEVGKKVHMFTRGGIRNHPEQAMILMMLEKTDGLLREAGYSPDCSHVLHDVDEEEKVDSLSRHSERLAVAYGLLKLPEGVPIRVMKNLRVCGDCHAAIKLISKVTEREIILRDANRFHHFNNGECSCRDYCWVRTEIEKSANFILYVDKKQVYVSVVLMGSEGPTGVTIHITGFKKFHGVAENPTEKMANNLKEYLAKNCVSKDLILGSCTVLETAGQGALASLYQMLQSAVNTKESELLTGKTIWVHFGVNSGATKFAIEQQAVNEATFRCPDELGWKPQNLPIVPSDGPISTVRKTNLPIKEIRKALEKKGFEVITSDDAGRFVCNYVYYHSLRFAEQNKTKSLFVHVPLFVAVDEETQMRFTVSLLEVLASICK

SEQ ID NO: 5903 - protein, 138 aa, Cleome gynandra
MGSEGPPAVTIHVTGFKKFHGVAENPTEKMVTNLKEYVAKNCLSKYIVLGSCNVLETAGEGAVASLYQMLQSSVSSKESESLNCGRTIWVHFGVNSGATKFGIEQQAFNEATFRCPDEMGWKPQKLPIIPNDGQISTC

SEQ ID NO: 5904 - protein, 234 aa, Unknown
  Sequence found in Organisms: Brassica napus, Brassica oleracea
MLGIFSGAIVSLPEELVAAGSRTPSPKTTGATLVNKFVEKNPSAVSVQVGDYVQLAYTHHKESPLRPRSFGAKDEIFCLFQGSLDNLGSLKQQYGLAKNANEVLLVIEAYKTLRDRAPYPANHVVSHLSGDFAFVVFDKSTSTLFVASDQVGKVPLYWGITADGYVAFADDLDLLKGACGKSLASFPQGCFYSTALGGLRSFENPKNKITAIPAKEEEIWGATFKVEGATVLAD

SEQ ID NO: 5905 - protein, 234 aa, Raphanus sativus
MLGIFSGAIVSLPEELVAAGSRTPSPKTTGSALVNKFVEKNPSAVSVQVGDYVQLAYTHHKESPLRPRSFGAKDEIFCLFQGSLDNLGSLKQQYGLAKNANEVLLVIEAYKTLRDRAPYPANHVVSHLSGDFAFVVFDKSTSTLFVASDQVGKVPLYWGITADGYVAFADDLELLKGACGKSLASFPQGCFYSTALGGLRSFENPKNKITAIPAKEEEIWGATFKVEGATVLAD

SEQ ID NO: 5906 - protein, 234 aa, Raphanus sativus
  misc_feature (39)..(39): Xaa can be any naturally occurring amino acid
MLGIFSGAIVSLPEELVAAGSRTPSPKTTGAALVNKFIXKNPSAVSVQVGDYVQLAYSHHKESPLRPRSFGAKDEIFCLFQGSLDNLGSLKQQYGLAKNANEVLLVIEAYKTLRDRAPYPANHVVAHLSGDFAFVVFDKSTSTLFVASDQEGKVPLYWGITADGYVAFADDVELLKGACGKSLASFPQGCFYSTTLGGLRSFENPKNKITAIPAKEEEIWGATFKVEGATVLAD

SEQ ID NO: 5907 - protein, 234 aa, Brassica oleracea
MLGIFSGAIVSLPEELVAAGSRTPSPKTTGAALVNKFVEKNPSAVTVQVGDYVQLAYTHHKESPLRPRSFGAKDEIFCLFQGSLDNLGSLKQQYGLAKNANEVLLVIEAYKTLRDRAPYPANHVVAHLSGDFAFVVFDKSTSTLFVASDQEGKVPLYWGITADGYVAFADDVELLKGACGKSLASFPQGCFYSTALGGLRSFENPKNKITAIPAKEEEIWGATFKVEGATVLAD

SEQ ID NO: 5908 - protein, 234 aa, Unknown
  Sequence found in Organisms: Brassica napus, Brassica rapa
MLGIFSGAIVSLPEELVAAGSRTPSPKTTGATLVNKFVQKNPSAVSVQVGDYVQLAYTHHKESPLRPRSFGAKDEIFCLFQGSLDNLGSLKQQYGLAKNANEVLLVIEAYKTLRDRAPYPANHVVSHLSGDFAFVVFDKSTSTLFVASDQVGKVPLYWGITADGYVAFADDLDLLKGACGKSLASFPQGCFYSTALGGLRSFENPKNKITAIPAKEEEIWGATFKVEGATVLAD

SEQ ID NO: 5909 - protein, 234 aa, Brassica juncea
MLGIFSGAIVSLPEELVAAGSRTPSPKTTGATLVNKFVQKNPSAVSVQVGDYVQLAYTHHKESPLRPRSFGAKDEIFCLFQGSLDNLGSLKQQYGLAKNVNEVLLVIEAYKTLRDRAPYPANHVVSHLSGDFAFVVFDKSTSTLFVASDQVGKVPLYWGITADGYVAFADDLDLLKGACGKSLASFPQGCFYSTALGGLRSFENPKNKITAIPAKEEEIWGATFKVEGATVLAD

SEQ ID NO: 5910 - protein, 234 aa, Brassica napus
MLGIFSGAIVSLPEELVAAGSRTPSPKTTGAALVNKFVEKNPSAVTVQVGDYVQLAYTHHKESPLRPRSFGAKDEIFCLFQGSLDNLGSLKQQYGLAKNTNEVLLVIEAYKTLRDRAPYPANHVVAHLSGDFAFVVFDKSTSTLFVASDQEGKVPLYWGITADGYVAFADDVELLKGACGKSLASFPQGCFYSTALGGLRSFENPKNKITAIPAKEEEIWGATFKVEGATVLAD

SEQ ID NO: 5911 - protein, 236 aa, Raphanus sativus
MLGIFSGAIVSLPEELVAAGNRTPSPKTTGSVLVNKFVEKNPSAVSVQVGDYVQLAYSHHKESPLRPRSFGAKDEIFCLFQGSLDNLGSLKQQYGLAKNANEVLLVIEAYKTLRDRAPYPANHVVSHLSGDFAFVVFDKSTSTLFVASDQEGKVPLYWGITADGYVAFADDIELLKGACGKSLASFPQGCFYSTALGGLRSFENPKNKITAIPAKEEEIWGATFKVEGAAVLAHGD

SEQ ID NO: 5912 - protein, 236 aa, Unknown
  Sequence found in Organisms: Brassica napus, Brassica juncea, Brassica rapa
MLGIFSGAIVSLPEELVAAGNRTPSPKTTGSVLVNKFVEKNPSAVSVQVGDYVQLAYSHHKESPLRPRSFGAKDEIFCLFQGSLDNLGSLKQQYGLAKNANEVLLVIEAYKTLRDRAPYPANHVVSHLSGDFAFVVFDKSTSTLFVASDQEGKVPLYWGITADGYVAFADDIELLKGACGKSLASFPQGCFYSTALGGLRSFENPKNKITAIPAREEEIWGATFKVEGAAVLAHGE

SEQ ID NO: 5913 - protein, 234 aa, Brassica napus
MLGIFSGAIVSLPEELVAAGSRTPSPKTTGAALVNKFVEKNPSAVTVQVGDYVQLAYTHHKESPLRPRSFGAKDEIFCLFQGSLDNLGSLKQQYGLAKNTNEVLLVIEAYKTLRDRAPYPANHVVAHLSGDFAFVVFDKSTSTLFVASDLEGKVPLYWGITADGYVAFADDVELLKGACGKSLASFPQGCFYSTALGGLRSFENPKNKITAIPAKEEEIWGATFKVEGATVLAD

SEQ ID NO: 5914 - protein, 236 aa, Brassica oleracea
MLGIFSGAIVSLPEELVAAGNRTPSPKTTGSVLVNKFVEKNPSAVSVQVGDYVQLAYSHHKESPLRPRSFGAKDEIFCLFQGSLVNLGSLKQQYGLAKNANEVLLVIEAYKTLRDRAPYPANHVVSHLSGDFAFVVFDKSTSTLFVASDQEGKVPLYWGITADGYVAFADDIELLKGACGKSLASFPQGCFYSTALGGLRSFENPKNKITAIPAREEEIWGATFKVEGAAVLAHGD

SEQ ID NO: 5915 - protein, 234 aa, Arabidopsis lyrata
MLGIFSGAIVSPPEELVAAGSRTPSPKTTGATLVKRFVEKNPSAVSVQVGDYVQLAYSHHNESPLRPRSFGAKDEIFCLFQGSLDNLGSLKQQYGLAKNANEVLLVIEAYKTLRDRAPYPANHVVAHLSGDFAFVVFDKSTSTLFVASDQVGKVPLYWGITADGYVAFADDVELLKGACGKSLASFPQGCYYSTALGGLRSFENPKNKITAVPANEEEIWGATFKVEGATVLAD

SEQ ID NO: 5916 - protein, 236 aa, Brassica juncea
MLGIFSGAIVSLPEELVAAGSRTPSPKTTGEALVNKFVEKNPFAVSVQVGDYVQLAYSHHKESPLRPRSFGAKDEIFCLFQGSLDNLGSLKQQYGLAKNANEVLLVIEAYKTLRDRAPYPANHVVSHLSGDFAFVVFDKSTSTLFVASDQVGKVPLYWGITADGYVAFADDLELLKGACGKSLASFPQGCFYSTALGGLRSFENPKNKITAIPAREEEIWGATFKVEGAAVLAHGE

SEQ ID NO: 5917 - protein, 193 aa, Brassica juncea
MLGIFSGAIVSLPEELVAAGNRTPSPKTTGSVLVNKFVEKNPSAVSVQVGDYVQLAYSHHKESPLRPRSFGAKDEIFCLFQGSLDNLGSLKQQYGLAKNANEVLLVIEAYKTLRDRAPYPANHVVSHLSGDFAFVVFDKSTSTLFVASDQEGKVPLYWGITADGYVAFADDIELLKGACGKSLASFPQGCRWA

SEQ ID NO: 5918 - protein, 234 aa, Arabidopsis thaliana
MLGIFSGAIVSPPEELVAAGSRTPSPKTTGSTLVNRFVEKNPSAVSVQVGDYVQLAYSHHNESPLRPRSFGAKDEIFCLFQGSLDNLGSLKQQYGLAKNANEVLLVIEAYKTLRDRAPYPANHVVAHLSGDFAFVVFDKSTSTLFVASDQVGKVPLYWGITADGYVAFADDVDLLKGACGKSLASFPQGCYYSTALGGLRSFENPKNKITAVPANEGEIWGATFKVEGATVLAD

SEQ ID NO: 5919 - protein, 234 aa, Thellungiella halophila
MLGIFSGAVVSPPEELVAAGSRTPSPKTTGEALVKRFVGKNPSAVCIQVGDDVQLAYSHHKENPLRPRSFGAKDEIFCLFQGSLDNLGSLKQQYGLAKNANEVLLVIEAYKTLRDRAPYPANHVVAHLSGDFAFVVFDKSTSTLFVASDQAGKVPLYWGITADGCVAFADDVELLKGACGKSLASFPQGCYYSTALGGLRSFENPKNKITAIPAKEEEIWGATFKVEGAAVLAD

SEQ ID NO: 5920 - protein, 221 aa, Raphanus sativus
EELVAAGSRTPSPKTTGSALVNKFVEKNPSAVSVQVGDYVQLAYTHHKESPLRPRSFGAKDEIFCLFQGSLDNLGSLKQQYGLAKNANEVLLVIEAYKTLRDRAPYPANHVVSHLSGDFAFVVFDKSTSTLFVASDQVGKVPLYWGITADGYVAFADDLDLLKGACGKSLASFPQGCFYSTALGGLRSFENPKNKITAIPAKEEEIWGATFKVEGATVLAD

SEQ ID NO: 5921 - protein, 218 aa, Brassica juncea
AGNRTPSPKTTGAVLVNKFVEKNPSAVSVQVGDYVQLAYSHHKESPLRPRSFGAKDEIFCLFQGSLDNLGSLKQQYGLAKNANEVLLVIEAYKTLRDRAPYPANHVVSHLSGDFAFVVFDKSTSTLFVACDQEGKVPLYWGITADGHVAFADDVELLKGACGKSLASFPQGCFYSTALGGLRSFENPKNKITAIPAKEEEIWGATFKVEGAAVLAHGE

SEQ ID NO: 5922 - protein, 235 aa, Brassica napus
  misc_feature (5)..(5): Xaa can be any naturally occurring amino acid
  misc_feature (52)..(52): Xaa can be any naturally occurring amino acid
  misc_feature (58)..(58): Xaa can be any naturally occurring amino acid
  misc_feature (87)..(87): Xaa can be any naturally occurring amino acid
  misc_feature (101)..(101): Xaa can be any naturally occurring amino acid
  misc_feature (115)..(115): Xaa can be any naturally occurring amino acid
MLGIXSGAIVSLPEELVAAGSRTPSPKTTGAALVNKFVEQNPSVVTVQVGDXVQLAYXHHKESPLRPRSFGAKDEIFCLFQGSLDNXGSLKQQYGLAKNAXEVLLVIEAYKTLRXRAPYPANHVVAHLSGDFAFVVFDKSTSTLFVASDQEGKVLLYWGITADGYVAFADDVELLKGACGKSLASFRQGCFYSTAVGGLRSFENPKNKITAIPAKEEEIWGATFKLIDSSRTNHI

SEQ ID NO: 5923 - protein, 236 aa, Cleome spinosa
MLGVFSGAVVTPPDELVLAGSRTPSPKTTATALVKRFVDGNSSAVSVQVGDHVQLAYTHHNESPLRPRSFAAKDEIFCLFEGALDNLGSLKQQYGLAKQANEVLLVIEAYKALRDRAPYPANHVVAHLIGSFSFVLFDKSTSTLFVASDQYGSVPLYWGITADGYVAFANDAELLKSACGKSLASFPQGCFYSTTIGGLRSFENPKNKITAIPAKEEEIWGATFKVEGPAVLAATE

SEQ ID NO: 5924 - protein, 236 aa, Cleome gynandra
MLGVFSGAVVTPPDELVLAGSRTPSPKTTAAALVKKFIDSNSSAVSVQISDHVQLAYTHHNESPLRPRSFAAKDEIFCLFEGALDNLGSLKQQYGLAKSANEVLLVIEAYKALRDRAPYPANHVVAHLLGSFAFVVFDKSTSTLFVASDQYGNVPLYWGITADGYVAFANDAELLKSACGKSLASFPQGCFFSTTVGGLRSFENPKNKITAIPAKEEEIWGATFKVEGPGVVAATE

SEQ ID NO: 5925 - protein, 236 aa, Papaver somniferum
  misc_feature (60)..(60): Xaa can be any naturally occurring amino acid
  misc_feature (129)..(129): Xaa can be any naturally occurring amino acid
  misc_feature (236)..(236): Xaa can be any naturally occurring amino acid
MLGVFSGAIVTAPDELVAAGSRTPSPKTTSATLVNRFVDKNGGAVSVQVGDQVHLAYTHXDESPFQPRSFAVKDEIFCLFEGALDNLGSLKQQYGLSKSANEVMLVIEAYKALRDRAPYPANHVVGHLXGSFAFVVFDKSTSTLFVASDQYGKVPLYWGITADGCVAFANDVDLLKGACGKSLASFPQGCFYSTAIGGLRSYENPKNKITAIPAKDEEIWGATFKVEGSAVVAATX

SEQ ID NO: 5926 - protein, 236 aa, Prunus persica
MLGVFSSAIVSPPDELVAAGSRTPSPKITAAALVNRFVQNNGNAVSVQVGDHAQLAYSHSNESALQPRSFAVKDEIFCLFEGALDNLGSLRQQYGLAKFANEVLLVIEAYKALRDRAPYPPNHVVGHLSGNFAFIVFDKSTSTLFVASDQYGKVPLSWGITADGYVAFADDAELLKGACGKSLASFPQGCFYSTAVGGLRSYENPKNKITAIPATEEEFWGATFKVEGPAVFAATK

SEQ ID NO: 5927 - protein, 236 aa, Castanea mollissima
MLGVFSGSIVSPPEELVAAGSRTPSPKTTSAALVNRFVETNASTVSIQAGDQVQLVYTHHKESPLLPRSFAVKDEIFCLFEGALDNLGSLRQQYGLAKSANEVVLVIEAYKALRDRAPYPANHVVGHLSGNFAFIVFDKSTSTLFVASDQYGKVPLYWGITADGYVAFADDADLLKGSCGKSLASFPQGCFFSTAAGGLMSYENPKNKITAVPATDEEIWGATFKVEGPAVVAATE

SEQ ID NO: 5928 - protein, 235 aa, Glycyrrhiza uralensis
MLGIFSSSVVSPPEELVAAGSRTPSPKTTADSLLKRFVESKASAVSLQVGDHVQLAYTHHDESPWQPRSFAAKDEIFCLFEGALDNLGSLRQQYGLAKSANEAVMVIEAYKALRDRAPYPANHVVGHLSGSFAFIVFDKSTSTLFVASDQSGKVPLYWGITADGYVAFADDADLLKGACGKSLASFPQGCFYSTEVGGLRCYENPKNKITAVPAEEEEIWGATFKVEGPAVLAAK

SEQ ID NO: 5929 - protein, 236 aa, Juglans hindsii x Juglans regia
MLGVFSSSIVSPPEELVAAGCRTPSPKITSAALLNRFEQTNASAVSVHVGDNVQLAYTHHKESPLLPRSFAVKDDIFCLFEGALDNLGSLRQQYGLAKSANEVILVIEAYKALRDRAPYPPSHVVGHLSGSFAFVVFDKSTSTLFVASDQYGKVTLYWGITADGYVAFADDAELLKGACGKSLASFPQGCFFSTTIGELRSFENPKNKITAVPATDEEIWGATFKVEGPAVLASTE

SEQ ID NO: 5930 - protein, 236 aa, Juglans hindsii x Juglans regia
  misc_feature (94)..(94): Xaa can be any naturally occurring amino acid
MLGVFSGSIVSPPEELVAAGCRTPSPKITSAALLNRFIETNASAVSIHVGDEVQLAYTHHKESPLLPRSFAVKDEIFCLFEGALDNLGSLKQQXGLAKSANEVVLVIEAYKALRDRAPYPANHVVGHLSGSFAFVVFDKSTSTLFVASDQYGKVPLYWGITADGYVAFADNAELLQGACGKSLASFPQGCFFSTTVGELRSYENPKDKITAVPATDEEIWGATFKVEGPAVVAATE

SEQ ID NO: 5931 - protein, 236 aa, Tropaeolum majus
MLGVFSSAIVSPPDELVAAGCRTPSPKISANSLVNRFIENNAFPVSVQIGDHVQLAYTHHNESPIKPRSFAVKDEIFCLFEGGLDNLGSLSKQYGLAKSTNEVLLVIEAYKTLRDRAPYPANHVVGHLSGDFAFIVFDKSTSTLFVASDQYGKIPLYWGITADGYVAFADNAELLKGACGKSLASFPQGCFFSTTVGGLRSYENPKNKITAVPAEEEEIWGATFKVEGPTVFAGTK

SEQ ID NO: 5932 - protein, 236 aa, Malus domestica
MLAVFSSAIVSPPDELVAAGSRTPSPKITAASLVNRFVQTNVAAVSIQVGDDAQLAYSHSNESPLQPRSFAVKDEIFCLFEGALDNLGSLRQQYGLAKSANEVILVIEAYKALRDRAPYPPNHVVGHLSGNFAFIVFDKSTSTVFVASDQFGKIPLSWGITADGYVAFADDVELLKGACGKSLASFPQGCFYSTTVGGLRSFENPKNKITAVPATDEEIWGATFKVEGPSVFAATK

SEQ ID NO: 5933 - protein, 236 aa, Citrus sinensis
MLGVFSSAIVSPPEELVAAGSRTPSPKTTSTALVDRFLQTNSSAVSVQVGDNVTLAYTHQNESPLRQRSFAVKDEIFCLFEGALDNLGSLRQQYGLAKSANEVILVIEAYKALRDRAPYPPNHVVGHLSGYFAFIVYDKSTSTLFVASDQFGKVPLYWGITADGHVAFADDADLLKGACGKSLASFPQGCFFSTAVGGLRSFENPKNKITAVPAAEEEIWGATFKVEGPAVLAATE

SEQ ID NO: 5934 - protein, 236 aa, Gossypium hirsutum
MLGVFSSAIVSPPDELVAAGCRTPSPKITADALVKRFLETNSSGVSMQIGDHVQFAYSHHKESPLRPRSFAVKDEIFCLFEGALDNLGSLKQQYGLAKSANEVILVIEAYKALRDRAPYPPNHVVGHLIGSFAFIVFDKSTSTLFVASDQFGKVPLYWGITADGYVAFADNAELLKGACGKSLASFPQGCFYSTAVGGLRSYENPKNKITAVPAEEEEIWGAKFKVEGPAVVAATE

SEQ ID NO: 5935 - protein, 236 aa, Quercus alba
MLGVFSGSIVSPPEELVAAGCRTPSPKITSGALVKRFVETNASTVSVQAGDHVQLAYTHHNQSPLLPRSFAVKDEIFCLFEGALDNLGSLRQQYGLAKSANEVVLVIEAYKALRDRAPYPANHVVGHLSGNFAFIVFDKSTSNLFVASDQDGKVPLYWGITADGYVAFADDADLLKGACGKSLASFPQGCFFSTAIGGLMSYENPKNKITAVPATDEEIWGATFKVEGPAVFAATE

SEQ ID NO: 5936 - protein, 64 aa, Quercus alba
MRILRTRSLQFLLLMKRSGVQHSRWKGQQFLQPQSRDFTSLVDTRQTKCISIWERRVFYMARCA

SEQ ID NO: 5937 - protein, 74 aa, Quercus alba
MLGVFSGSIVSPPEELVAAGCRTPSPKITVGGAGETVRGDQCIHGVRASRRPRAIGLHTPQPVSFAPQVVCSEG

SEQ ID NO: 5938 - protein, 74 aa, Quercus alba
MRILRTRSLQFLLLMKRSGVQHSRWKGQQFLQPQSRDFTSLVDTRQTKCISIWERRGFFIWLGAHEGPCKYLSM

SEQ ID NO: 5939 - protein, 236 aa, Trifolium pratense
MLGIFSSSVVSPPEELVAAGSRTPSPKTTANLLLKRFVERKASAVSLQVGEDVQLAYTHHEESPWQPRSFAVKDDIFCLFEGTLDNLGSLRQQYGLAKSANEVVLMIEAYKALRDRAPYPANHVVGHLSGSFAFIVFDKSTSTLFVASDQSGKVPLYWGITADGYVAFADDADLLKGACGKSLASFPQGCFYSTAVGGLRCYENPKNKITAVPANEEEIWGATFKVEGPAVLAATE

SEQ ID NO: 5940 - protein, 237 aa, Actinidia deliciosa
MLGVFSSSIVSPPDELVAAGCRTPSPKITASALVDRFLQTNPSGVSVQIGDHVQLAYTHHNESPLRPRSFAVKDEIFCLFEGALDNLGSLRQQYGLAKSANEVVLVIEAYKALRDRAPYPPNHVVGHLVGNFAFVVFDKSTSTLFVAADQFGKVPLYWGITADGYVAFANDADLLKGACGKSLASFPQGCFYSTTVGELRSYENPKNKITAVPATEEEIWGAKFMVEGTTVLAAATK

SEQ ID NO: 5941 - protein, 195 aa, Raphanus sativus
MLGIFSGAIVSLPEELVAAGNRTPSPKTTGSVLVNKFVEKNPSAVSVQVGDYVQLAYSHHKESPLRPRSFGAKDEIFCLFQGSLDNLGSLKQQYGLAKNANEVLLVIEAYKTLRDRAPYPANHVVSHLSGDFAFVVFDKSTSTLFVASDQEGKVPLYWGITADGYVAFADDVELLKSACGKSLASFPQAVSTRLR

SEQ ID NO: 5942 - protein, 236 aa, Tropaeolum majus
MLGVFSSAIVSPPDELVAAGCRTPSPKISATSLVNRFVETNASAVSVQIGDHVQLAYTHHNESPLRPRSFAVKDEIFCLFEGVLDNLGSLRQQYGLTKSTNEVLLVIEAYKALRDRAPYPANHVVGHLSGDFAFIVFDMSTLNLFVASDQYGKIPLSWGITADGYVAFADNAELLKGACGKSLASFPQGCFFSTAVGELRSYENPKNKITAVPAKEEEIWGATFKVEGPTVFAATK

SEQ ID NO: 5943 - protein, 236 aa, Quercus alba
MLGVFSGSIVSPPEELVAAGCRTPSPKITSGALVKRFVETNASTVSVQAGDHVQLAYTHHNQSPLLPRSFAVKDEIFCLFEGALDNLGSLRQQYGLAKSANEVVLVIEAYKALRDRAPYPANHVVGHLSGNFAFIVFDKSTSNLFVASDQDGKVPLYWGITADGYVAFADDADLLKGACGKSLASFPQGCFFSTTIGGLMSYENPKNKITAVPATDEEIWGATFKVEGPAVFAATE

SEQ ID NO: 5944 - protein, 236 aa, Malus domestica
MLGVFSSAIVSPPEELVAAGSRTPSPKITATSLVNRFVQTNDAAVSVQVGDDAQLAYSHSNESALQPRSFAVKDEIFCLFEGALDNLGSLRQQYGLAKSANEVILVIEAYKALRDRAPYPPNHVVGHLSGNFAFIVFDKSTSTVFVASDQFGKIPLSWGITADGYVAFADDAELLKGACGKSLASFPQGCFYSTSVGGLRSYENPKNKITAVPATDEEIWGATFKVEGPAVLAATK

SEQ ID NO: 5945 - protein, 236 aa, Gossypium hirsutum
MLGVFSSAIVSPPDELVAAGCRTPSPKITADALVKRFLETNSSGVSMHIGDHVQFAYSHHKESPLQPRSFAVKDEIFCLFEGALDNLGSLKQQYGLAKSANEVILVIEAYKALRDRAPYPPNHVVGHLIGSFAFIVFDKSTSTLFVASDQFGKVPLYWGITADGYVAFADNAELLKGACGKSLASFPQGCFYSTAVGGLRSYENPKNKITAVPAEEEEIWGAKFKVEGPTVVAATE

SEQ ID NO: 5946 - protein, 236 aa, Quercus alba
MLGVFSGSIVSPPEELVAAGCRTPSPKITSAALVKRFVESNASTVSVQAGDHVQLAYTHHNQSPLLPRSFAVKDEIFCLFEGALDNLGSLRQQYGLAKSANEVILVIEAYKALRDRAPYPANHVVGHLSGNFAFIVFDKSTSSLFVASDQDGKVPLYWGITADGYVAFADDADLLKGACGKSLASFPQGCFFSTAVGGLMSYENPKNKITAVPATDEEIWGATFKVEGPAVFAATE

SEQ ID NO: 5947 - protein, 236 aa, Glycine max
MLGIFSSSVVSPPEELVAAGSRTPSPKTTAGKLLNRFVENKASAVSLQVGEHVQLAYTHHNESPWHPRSFAVKDEIFCLFEGALDNLGSLRQQYGLAKSANEVVLVIEAYKALRDRAPYPANRVVCHLSGSFAFIVFDKSTSTLFVASDQAGKVPLYWGITADGYVAFADDADLLKGSCGKSLASFPQGCFYSTAVGGLRCYENPKNKITAIPAEEEEIWGAFFKVEGSAVLAGTE

SEQ ID NO: 5948 - protein, 236 aa, Glycine max
MLGVFSSSIVSPPEELVAAGSRTPSPKMTAAALRKWFEEKNPSAVSVEVGEHVQLAYTHQNESPFQPRSFAVKDEVFCLFEGALDNLGNLRQQYGLAKSTNEVLLVIEAYKALRDRAPYPANHVVGHLSGSFAFIVFDKSTSTLFVASDQYGKVPLYWGITADGYVAFADDAELLKGACGKSLASFPQGCFYSTAVGGLMCYENPKNKITAVPANEEEIWGATFKVEGPAVVVARQ

SEQ ID NO: 5949 - protein, 236 aa, Glycine max
MLGIFSSSVVSPPEELVAAGSRTPSPKTTAGKLLNRFVESKASAVSLQVGEHVQLAYTHHNESPWHPRSFAVKDEIFCLFEGALDNLGSLRQQYGLAKSANEVILVIEAYKALRDRAPYPANRVVCHLSGSFAFIVFDKSTSTLFVASDQAGKVPLYWGITADGYVAFADDADLLKGSCGKSLASFPQGCFYSTAVGGLRCYENPKNKITAVPAEEEEIWGAFFKVEGSTVLAATE

SEQ ID NO: 5950 - protein, 132 aa, Brassica juncea
KTKSVEVNKKLNVLIVDDDTVTRKLHESIIKAIGGISQTAKNGEEAVNIHRDGNASFDLILMDKEMPERDDGVLATKKLREMKVTSVIIGVTSLADNEDERKAFMEAGLNHCLAKPLSKAKILPLINNLMDA

SEQ ID NO: 5951 - protein, 228 aa, Arabidopsis lyrata
MATNEPEHEHRDEEEAGANEDEDTGAQVAPIVRLEEVAVTTGEEDEDAVLDLKSKLYRFDKDANQWKERGAGTVKLLKHKNTGKIRLVMRQSKTLKICANHFVKSGMSVQEHVGNEKSCVWHARDFADGELKDELFCIRFASIENCKTFMQKFKEVADSEEEKEESKDASDTAGLLEKLTVEETKTEEKTEAKAVETVKTEVKAEEKKESEAEKSGEEKKIEETGPST

SEQ ID NO: 5952 - protein, 228 aa, Arabidopsis thaliana
MATNEPEHEHRDEEEAGANEDEDTGAQVAPIVRLEEVAVTTGEEDEDAVLDLKSKLYRFDKDANQWKERGAGTVKFLKHKNTGKIRLVMRQSKTLKICANHFVKSGMSVQEHVGNEKSCVWHARDFADGELKDELFCIRFASIENCKTFMQKFKEVAESEEEKEESKDAADTAGLLEKLTVEETKTEEKTEAKAVETAKTEVKAEEKKESEAEKSGEAKKTEESGPST

SEQ ID NO: 5953 - protein, 254 aa, Brassica napus
IFAVPLEMIWCKNHTKIVFCSSIGAGLSRTVASERANPRGYLSPQILWRPTNPSTRPETRKRPELTRLEEVVVTTGEEDEDAVLDLKSKLYRFDKEANQWKERGAGTVKLLKHKDTGKIRLVMRQSKTLKICANHFVKPGMAVQEHVGNEKSCVWHALDFADGELKDELFCIRFASIENCRLFMQKFNEVAESEAEKEERKDASETAGLLEKLTVEETKTEEKVKTEVEAEEKKKSEPEKADEEKKTEEAAPLT

SEQ ID NO: 5954 - protein, 212 aa, Brassica napus
MATNEPEHETRDAEEAGANEDEDTGAQVAPIVRLEEVAVTTGEEDEDAVLDLKSKLYRFDKEANQWKERGAGTVKLLKHKDTGKIRLVMRQSKTLKICANHFVKPGMAVQEHVGNEKSCVWHARDFADGELKDELFCIRFASIENCKLFMQKFNEVAESEAEKEESKDASETAGLLEKLTVEETKTEEKVKTEEKKKASQRRLMKKRKPKRL

SEQ ID NO: 5955 - protein, 224 aa, Cleome spinosa
MATNEPQHENREEEETVANEDEDTGAQVAPIVRLEEVAVTTGEEDEDAILDLKSKLYRFDKDGNQWKERGAGTVKFLKHKGTSKIRLVMRQSKTLKICANHLILPGMTVQEHVGNEKSCVWHASDFSEGELKDELFCIRFASVENCKTFMQKFKEVAESEEKKEEDKDASEAAGLLEKLTVKEKETEEKPVEEAPSTKEEEKKSEPEKAGEEKKKTDEESGSST

SEQ ID NO: 5956 - protein, 237 aa, Brassica napus
MGYWNSKVVPRFKKIFEKNSAKKAAAAEACKTFDESKETINKEIEEKKTELQPKVVETYEATSAEVKALVRDPKEAGLKKNSAAVLKYLEALVGIEFPGSTAVKEAASSFGAGYVSGPVTFIFEKVCVFLPEEVKTREVPVEEVKAEEPAKTEEPVKTEETSGEKEKEIVEETKKEETVATAVVEEKKPEVEKEEEKKPVVEEVKKEEAAPAPAVVETPVTAPETTTPAPVAEPPKP

SEQ ID NO: 5957 - protein, 237 aa, Brassica oleracea
MGYWNSKVVPRFKKIFEKNSAKKAAAAEACKTFDESKETINKEIEEKKTELQPKVVETYEATSAEVKALVRDPKEAGLKKNSAAVLKYLEALVGIEFPGSTAVKEAASSFGAGYVAGPVTFIFEKVCVFLPEEVKTREVPVEEVKAEEPAKTEEPVKTEETSGEKEKEIVEETKKEETVATAVVEEKKPEVEKEEEKKPVVEEVKKEEAAPAPAVVETPVTAPETTTPAPVAEPPKP

SEQ ID NO: 5958 - protein, 238 aa, Brassica juncea
MGYWNSKVVPRFKKIFEKNSAKKAAAAEACKTFDESKETINKEIEEKKTELQPKVVETYEATSAEVKALVRDPKEAGLKKNSAAVQKYLEALAAIEFPGSSAVKDVASSFGAGYVSGPVTFIFEKVCVFLPEEVKTREVPVEEVKAEEPAKTEEPAKTEETSGEKDEEIVEETKKEETVTSTVVEEQKPEVVKEEEKTNVKEVKKEEAVPPLAPEVVETPAKAPETTTPAPVAEPPKP

SEQ ID NO: 5959 - protein, 232 aa, Brassica oleracea
MGYWNSKVVPRFKKIFEKSSVKKAAAAEACKTFDESKEAINKEIEEKKTELQPKVVETYEATSAEVKALVRDPKEAGLKKNSAAVQKYLEALAAIEFPGSTAVKDAASSFGAGYVSGPVTFIFEKVCVFLPEEVKTREVPVKEVKAEEPAKTEEPAKTEEPSGEKEEIVEKTVTTAVVEEQKPEVAKEEEKKPIEEVKKEEAAPSPAPEVVESPAKAPETTTPAPVAEPSKP

SEQ ID NO: 5960 - protein, 232 aa, Brassica napus
MGYWNSKVVPRFKKIFEKSSVKKAAAAEACKTFDESKEAINKEIEEKKTELQPKVVETYEATSAEVKALVRDPKEAGLKKNSAAVQKYLEALAAIEFPGSTAVKDAASSFGAGYVSGPVTFIFEKVCVFLPEEVKTREVPVKEVKAEEPAKTEEPAKTEEPSGEKEEIVEKTVTTAVVEEHKPEVAKEEEKKPIEEVKKEEAAPPPAPEVVESPAKAPETTTPAPVAEPSKP

SEQ ID NO: 5961 - protein, 232 aa, Brassica napus
  misc_feature (10)..(10): Xaa can be any naturally occurring amino acid
  misc_feature (13)..(13): Xaa can be any naturally occurring amino acid
  misc_feature (25)..(25): Xaa can be any naturally occurring amino acid
  misc_feature (27)..(27): Xaa can be any naturally occurring amino acid
  misc_feature (36)..(36): Xaa can be any naturally occurring amino acid
  misc_feature (49)..(49): Xaa can be any naturally occurring amino acid
MGYWNSKVVXRFXKIFEKSSVKKAXAXEACKTFDEXKEAINKEIEEKKXELQPKVVETYEATSAEVKALVRDPKEAGLKKNSAAVQKYLEALAAIEFPGSTAVKDAASSFGAGYVSGPVTFIFEKVCVFLPEEVKTREVPVKEVKAEEPAKTEEPAKTEEPSGEKEEIVEKTVTTAVVEEHKPEVAKEEEKKPIEEVKKEEAAPPPAPEVVESPAKAPETTTPAPVAEPSKP

SEQ ID NO: 5962 - protein, 225 aa, Arabidopsis thaliana
MGYWNSKVVPKFKKLFEKNSAKKAAAAEATKTFDESKETINKEIEEKKTELQPKVVETYEATSAEVKALVRDPKVAGLKKNSAAVQKYLEELVKIEFPGSKAVSEASSSFGAGYVAGPVTFIFEKVSVFLPEEVKTKEIPVEEVKAEEPAKTEEPAKTEGTSGEKEEIVEETKKGETPETAVVEEKKPEVEEKKEEATPAPAVVETPVKEPETTTTAPVAEPPKP

SEQ ID NO: 5963 - protein, 224 aa, Arabidopsis lyrata
MGYWNSKVVPKFKKLFEKNSAKKAAAAEATKTFDESKETINKEIEEKKTELQPKVVETYEATSAEVKALVRAPKESGLKKNSAAVQKYLEELVKIEFPGSKAVSEATSSFGAGYVAGPVTFIFEKVCVFLPEEVKTKEIPVEEVKTEEPAKTEEPAKTEEPSGEKEEIVEEVKKDETPETVVVEDKKPEVEEKKEEATPAPAVVETPVKEPETTTAPVAEPPKP

SEQ ID NO: 5964 - protein, 78 aa, Unknown
  Sequence found in Organisms: Brassica napus, Brassica juncea, Brassica oleracea, Brassica rapa, Thellungiella halophila
MGGGNAQKSKMAREKNLEKARQAGKGSQLEANKKAMSIQCKVCMQTFICTTSEVKCREHAEAKHPKADVVACFPHLKK

SEQ ID NO: 5965 - protein, 78 aa, Brassica rapa
  misc_feature (40)..(40): Xaa can be any naturally occurring amino acid
MGGGNAQKSKMAREKNLEKARQAGKGSQLEANKKAMSIQXKVCMQTFICTTSEVKCREHAEAKHPKADVVACFPHLSK

SEQ ID NO: 5966 - protein, 78 aa, Raphanus sativus
MGGGNAQKSKMAREKNLEKARQAGKGSQLEANKKAMSLQCKVCMQTFICTTSEVKCREHAEAKHPKADVVACFPHLKK

SEQ ID NO: 5967 - protein, 78 aa, Unknown
  Sequence found in Organisms: Taraxacum officinale, Helianthus annuus
MGGGNAQKSKMAREKNLEKARAAGKGSQLEANKKAMNIQCKVCMQTFICTTSEVKCREHAEAKHPKADVEACFPHLKK

SEQ ID NO: 5968 - protein, 78 aa, Unknown
  Sequence found in Organisms: Taraxacum officinale, Carthamus tinctorius, Helianthus annuus
MGGGNAQKSKMAREKNLEKAKAAGKGSQLEANKKAMSIQCKVCMQTFICTTSEVKCREHAEAKHPKADVYACFPHLKK

SEQ ID NO: 5969 - protein, 78 aa, Gerbera hybrid cultivar
MGGGNAQKSKMAREKNLEKARAAGKGSQLEANKKAMNIQCKVCMQTFICTTSEVKCREHAEAKHPKADVYACFPHLKK

SEQ ID NO: 5970 - protein, 78 aa, Tragopogon dubius
MGGGNAQKSKMAREKNLEKAKAAGKGSQLEANKKAMNIQCKVCMQTFICTTSEVKCREHAEAKHPKADVYACFPHLKK

SEQ ID NO: 5971 - protein, 78 aa, Arabidopsis thaliana
MGGGNAQKSAMARAKNLEKAKAAGKGSQLEANKKAMSIQCKVCMQTFICTTSEVKCREHAEAKHPKADVVACFPHLKK

SEQ ID NO: 5972 - protein, 78 aa, Lactuca sativa
MGGGNAQKSKMAREKNLEKAKAAGKGSQLEANKKAMNIQCKVCMQTFICTTSEVKCREHAEAKHPKADVLACFPHLKK

SEQ ID NO: 5973 - protein, 94 aa, Cichorium intybus
MGGGNAQKSKMAREKNLEKAKAAGKGSQLEANKKAMNIQCKVCMQTFICTTSEVKCREHAEAKHPKADVYACFPHLKSGGYCELWLNDSIMSII

SEQ ID NO: 5974 - protein, 78 aa, Arabidopsis lyrata
MGGGNAQKSAMARAKNLEKAKAAGKGSQLEANKKAMSIQCKVCMQTFICTTSEVKCREHAEAKHPKADVDACFPHLKK

SEQ ID NO: 5975 - protein, 78 aa, Gerbera hybrid cultivar
MGGGNAQKSKMAREKNLEKAKAAGKGSQLEANKKAMNIQCKVCMQTFICTTSEVKCREHAEAKHPKADVYTCFPHLKK

SEQ ID NO: 5976 - protein, 78 aa, Artemisia annua
MGGGNAQKSKMAREKNLEKAKAAGKGSQLEANKKAMNIQCKVCMQTFICTTSEVKCREHAEAKHPKSDVLTCFPHLKK

SEQ ID NO: 5977 - protein, 78 aa, Helianthus annuus
MGGGNAQKSKMAREKNLEKAKAAAKGSQLEANKKAMNIQCKVCMQTFICTTSEVKCREHAEAKHPKADVYTCFPHLKK

SEQ ID NO: 5978 - protein, 78 aa, Helianthus annuus
MGGGNAQKSKMARDKNLEKAKAADKVSQLEANKKAMSIQCKVCMQTFICTTSEVKCREHAEAKHPKADVYTCFPHLKK

SEQ ID NO: 5979 - protein, 78 aa, Centaurea maculosa
  misc_feature (7)..(7): Xaa can be any naturally occurring amino acid
  misc_feature (31)..(31): Xaa can be any naturally occurring amino acid
  misc_feature (40)..(40): Xaa can be any naturally occurring amino acid
  misc_feature (45)..(45): Xaa can be any naturally occurring amino acid
MGGGNAXKSKMAREKNLEKAKAAGKGSQLEXNKKAMSIQXKVCMXTFICTTSEVKCREHAEAKHPKADVNACFPHLKK

SEQ ID NO: 5980 - protein, 78 aa, Gossypium hirsutum
MGGGNAQKSKMAREKNLEKAKNAAKGSQLETNKKAMTIQCKVCMQTFICTTSEVKCREHAEAKHPKSDVYACFPHLKK

SEQ ID NO: 5981 - protein, 78 aa, Ipomoea nil
MGGGNAQKSKMAREKNLEKMKAAGKGSQLESNKKAMNIQCKVCMQTFMCTTSEVKCREHAEAKHPKADVSTCFPHLKK

SEQ ID NO: 5982 - protein, 78 aa, Ocimum basilicum
MGGGNGQKSKMAREKNLEKLKAQQKGSQLEANKKAMSIQCKVCMQTFICTTSEVKCREHAEAKHPKADIYACFPHLKK

SEQ ID NO: 5983 - protein, 78 aa, Gossypium hirsutum
MGGGNAQKSKMAREKNLEKAKNAAKGSQLETNKKAMTIQCKVCMQIFICTTSEVKCREHAEAKHPKSDVYACFPHLKK

SEQ ID NO: 5984 - protein, 77 aa, Mesembryanthemum crystallinum
MGGGNAQKSKMAREKNLEKSKGAKGSQLDANKKAMSIQCKVCMQTFICTTTEVKCREHAEAKHPKQDVYACFPHLKK

SEQ ID NO: 5985 - protein, 130 aa, Helianthus annuus
MFDVTARLTYKNVPTWHRDLCRVCENIPIVLCGNKVDVKNRQVKAKQVTFHRKKNLQYYEISAKSNYNFEKPFLYLARKLAGDPNLHFVESPALAPPEVQIDMAAQQQHEAELAAAASQPLPDDDDDAFE

SEQ ID NO: 5986 - protein, 78 aa, Cleome spinosa
MGGGNAQKSKMAREKNLEKQKAAGKGSQLEMNKKAMSIQCKVCMQTFMCTTTEVKCREHAEAKHPKSDLFACFPHLKK

SEQ ID NO: 5987 - protein, 78 aa, Ipomoea batatas
MGGGNGQKSKMAREKNLEKMKAAGKGSQLETNKKAMNIQCKVCMQTFMCTTSEVKCREHAEAKHPKSDVYACFPHLKK

SEQ ID NO: 5988 - protein, 77 aa, Tropaeolum majus
MGGGNAQKSKTARERNLEKNKASKGSQLEANKKAMNIQCKVCMQTFICTTSEVKCREHAEAKHPKSDVTACFPHLKK

SEQ ID NO: 5989 - protein, 78 aa, Unknown
  Sequence found in Organisms: Castanea mollissima, Quercus alba
MGGGNAQKSKMAREKNLEKAKAAGKGSQLESNKKAMTIQCKVCMQTFMCTTSEVKCREHAGAKHPKSDVTACFPHLKN

SEQ ID NO: 5990 - protein, 77 aa, Unknown
  Sequence found in Organisms: Orobanche aegyptiaca, Nicotiana tabacum
MGGGNGQKAKMAREKNAEKMKGQKGSQLEANKKAMSIQCKVCMQTFICTTSEVKCREHAEAKHPKADVYACFPHLKK

SEQ ID NO: 5991 - protein, 78 aa, Gossypium hirsutum
MGGGNGQKSKMAREKNLEKQKAAGKGSQLESNKKAMSIQCKVCMQTFMCTTTEVKCREHAEAKHPKSDVYACFPHLKK

SEQ ID NO: 5992 - protein, 78 aa, Vigna unguiculata
MGGGNGQKSKMAREKNLEKQRAAGKGSQLDSNKKAMTIQCKVCMQTFMCTTSEVKCREHAEAKHPKSDVYACFPHLKK

SEQ ID NO: 5993 - protein, 77 aa, Lotus japonicus
MGGGNAQKAKMARERNLEKQKGAKGSQLETNKKAMSIQCKVCMQTFICTTSEVKCREHAEAKHPKSDVVTCFPHLQK

SEQ ID NO: 5994 - protein, 78 aa, Mimulus guttatus
MGGGNAQKAKMAREKNLEKSKAAGKGSQLDTNKKAMTIQCKVCMQTFMCTTSEVKCREHAEAKHPKADVFACFPHLQK

SEQ ID NO: 5995 - protein, 78 aa, Helianthus annuus
MGGGNAHKSKMAREKNLEKAKAAGKGSQLEAYKKAMSIQCKGCMLTFICTTSEVKCTEHAEAKHPRADVYACFPHLKK

SEQ ID NO: 5996 - protein, 96 aa, Artemisia annua
THSTVVSTQYSEGENKVSEPWVGNAQKSKMAREKNLEPKLLAKEVQLEANKKAMNIQCKVCMQTFICTTSEVKCREHAEAKHPKSDVLTCFPHLKK

SEQ ID NO: 5997 - protein, 78 aa, Cucumis sativus
MGGGNGQKSKMAREKNMEKLKAASKGDQLEANKKAMSIQCKVCMQTFICTTSEVKCREHAEAKHPKSDVHTCFPHLKK

SEQ ID NO: 5998 - protein, 78 aa, Cucumis melo
MGGGNGQKSKMAREKNMEKLKASSKGSQLEANKKAMSIQCKVCMQTFICTTSEVKCREHAEAKHPKSDVYTCFPHLKK

SEQ ID NO: 5999 - protein, 77 aa, Tropaeolum majus
MGGGNAQKSKTARERNLEKNKASKGSQLEANKKAMNIQCKVCMQTFICTTSEVKCREHAEAKHPKSDVFACFPHLKN

SEQ ID NO: 6000 - protein, 78 aa, Ocimum basilicum
MGGGNGQKSKMARERNLEKLKAQQKGSQLEANKKAMSIQCKVCMQTFICTTSEVKCREHAEAKHPKADIYTCFPHLKK

SEQ ID NO: 6001 - protein, 67 aa, Phaseolus coccineus
MAREKNIEKQRAAGKGSQLDSNKKAMSIQCKVCMQTFMCTTSEVKCREHAEAKHPKSDVYACFPHLK

SEQ ID NO: 6002 - protein, 77 aa, Manihot esculenta
MGGGNGQKSKMARERNMEKQKGAKGSQLESNKKAMSIQCKVCMQTFICTTSEVKCREHAEAKHPKSDVYACFPHLKK

SEQ ID NO: 6003 - protein, 78 aa, Cicer arietinum
MGGGNGQKAKMARERNLEKQKNAGKGSQLETNKKAMSIQCKVCMQTFICTTSEVKCREHAEAKHPKSDVLVCFPHLNK

SEQ ID NO: 6004 - protein, 77 aa, Actinidia deliciosa
  misc_feature (40)..(40): Xaa can be any naturally occurring amino acid
MGGGNGQKAKMAREKNLEKSKAAKGSQLESNKKAMSIQCXVCMQTFICTTSEVKCREHAEAKHPKADIYACFPHLKK

SEQ ID NO: 6005 - protein, 78 aa, Glycyrrhiza uralensis
MGGGNGQKAKMARERNLEKQKNAAKGSQLEANKKAMSIQCKVCMQTFICTTSEVKCREHAEAKHPKSDVYTCFPHLKK

SEQ ID NO: 6006 - protein, 78 aa, Arachis hypogaea
MGGGNAQKSKMARERNLDKQKAAAKGSQLETNKKAMSIQCKVCMQTFICTTSEVKCREHAEAKHPKSDLYACFPHLKK

SEQ ID NO: 6007 - protein, 77 aa, Capsicum annuum
MGGGNGQKAKMAREKNMEKMKAQKGSQLEANKKAMSIQCKVCMQTFICTTSEVKCREHAEAKHPKSDIYACFPHLKK

SEQ ID NO: 6008 - protein, 77 aa, Petunia hybrida
MGGGNGQKAKMAREKNAEKLKASKGSQLEANKKAMSIQCKVCMQTFICTTSEVKCREHAEAKHPKSDVYTCFPHLKK

SEQ ID NO: 6009 - protein, 78 aa, Petunia hybrida
MGGGNGQKAKMAREKNAEKLKAAGKGSQLETNKKAMSIQCKVCMQTFMCTTSEVKCREHAEAKHPKSDVLACFPHLKK

SEQ ID NO: 6010 - protein, 78 aa, Papaver somniferum
MGGGNGQKAKMAREKNAEKAKAAGKGSQLDANKKAMSIQCKVCMQTFICTTSEVKCREHAEAKHPKSDIYVCFPHLKK

SEQ ID NO: 6011 - protein, 78 aa, Rosa hybrid cultivar
MGGGNGQKAKMAREKNLEKQKAAGKGSQLEKNKKAMSIQCKVCMQTFMCTTSEVKCREHAEAKHPKSDVYACFPHLKP

SEQ ID NO: 6012 - protein, 78 aa, Glycine max
MGGGNAQKSKMAREKNLEKQRAAAKGSQLDSNKKAMSIQCKVCMQTFICTTSEVKCKEHAEAKHPKSDLHVCFPHLKK

SEQ ID NO: 6013 - protein, 77 aa, Picea glauca
MGGGNGQKAKMAREKNNEKNKAPKGSQLETNKKAMSIQCKVCMQTFICTTSEVKCREHAEAKHPKADVYQCFPHLKK

SEQ ID NO: 6014 - protein, 78 aa, Helianthus annuus
MAGGAAQKSKMAREKNLEKAKAAGKGSQLEAHKKAMSIQSKACMPTFICTTSEVKCREHAEAKHPKADVYACIPHLKK

SEQ ID NO: 6015 - protein, 83 aa, Triphysaria pusilla
MGGGNAQKSKTARERNAEKAKGSKGSQLDANKKAMSIQCKVCMQTFICTTSEVKCREHAEAKHPKADVATCFPHLKKEETPKK

SEQ ID NO: 6016 - protein, 115 aa, Triphysaria pusilla
MGGGNAQKSKTARERNAEKAKGSKGSQLDANKKAMSIQCKVCMQTFICTTSEVKCREHAEAKHPKADVVTCFPHLKRGNPQEMMHGLPTISLTNECIKYEAVFLSIVSKMFVINF

SEQ ID NO: 6017 - protein, 77 aa, Zamia vazquezii
MGGGNGQKSKMARERNLEKSKAPKGSQLDANKKAMTIQCKVCMQTFICTTSEVKCREHAEAKHPKADVYQCFPHLKK

SEQ ID NO: 6018 - protein, 73 aa, Salvia sclarea
MGRRRRWRERETWRSSKAKKGSQLETNKKAMTIQCKVCMQTFICTTSEVKCREHAEAKHPKADVYACFPHLKK

SEQ ID NO: 6019 - protein, 43 aa, Helianthus annuus
MTLQCKVCMPTFICTTSEVKCREHAEAKHPKADVYTCFPHLKK

SEQ ID NO: 6020 - protein, 77 aa, Solanum melongena
MGGGNGQKAKMAREKNMEKMKAQKGSQLEANKKAMNIQCKVCMQTFICTTSEVKCREHAEAKHPKSDVYTCFPHLKK

SEQ ID NO: 6021 - protein, 78 aa, Eschscholzia californica
MGGGNGQKAKMAREKNLEKSKAANKGSQLDANKKAMTIQCKVCMQTFICTTSEVKCREHAEAKHPKSDVETCFPHLKK

SEQ ID NO: 6022 - protein, 77 aa, Unknown
  Sequence found in Organisms: Castanea mollissima, Quercus alba
MGGGNGQKSKMARERNSEKQKGNKGSQLESNKKAMSIQCKVCMQTFICTTSEVKCREHAEAKHPKSDVYACFPHLKK

SEQ ID NO: 6023 - protein, 77 aa, Orobanche aegyptiaca
MGGGNAQKAKMAREKNLEKSKAQKGSQLDSNKKAMNIQCKVCMQTFMCTTSEVKCREHAEAKHPKSDVSACFPHLKK

SEQ ID NO: 6024 - protein, 78 aa, Cajanus cajan
MGGGNGQKAKMAREKNLEKQKAAAKGSQLETNKKAMNIQCKVCMQTFMCTTSEVKCREHAEAKHPKSDVYACFPHLQK

SEQ ID NO: 6025 - protein, 77 aa, Salvia sclarea
MGGGNAQKAKMAREKNLEKMKGAKGSQLESNKKAMNIQCKVCMQTFICTTSEVKCKEHAEAKHPKADLFTCFPHLKK

SEQ ID NO: 6026 - protein, 77 aa, Salvia sclarea
MGGGNAQKAKMAREKNLEKAKGSKGSQLDANKKAMNIQCKVCMQTFMCTTSEVKCREHVEAKHPKADVTTCFPHLKK

SEQ ID NO: 6027 - protein, 77 aa, Brassica napus
MGGGNAQKSKMAREKNLEKNKGSKGSQLEVNKKAMNIQCKVCMQTFICTTTEVKCREHAEAKHPKQDLYACFPHLKK

SEQ ID NO: 6028 - protein, 78 aa, Citrus sinensis
MGGGNGQKAKMAREKNLEKQKAANKGSQLETNKKAMSIQCKVCMQTFMCTTSEVKCREHAEAKHPKSDIYACFPHLKK

SEQ ID NO: 6029 - protein, 78 aa, Citrus sinensis
MGGGNGQKSKMAREKNMEKQRAAGKGSQLESNKKAMSIQCKVCMQTFICTTSEVKCKEHAEARHPKSDLFTCFPHLKK

SEQ ID NO: 6030 - protein, 78 aa, Gossypium hirsutum
MGGGNAQKSKTARERNLEKAKAGAKGSQLESNKKAMSIQCKVCMQEFMCTTSEVKCREHAEAKHPKSDVYACFPHLKK

SEQ ID NO: 6031 - protein, 77 aa, Cycas rumphii
MGGGNGQKSKMAREKNLEKSKAPKGSQLDSNKKAMTIQCKVCMQTFICTTSEVKCREHAEAKHPKADIYQCFPHLKK

SEQ ID NO: 6032 - protein, 78 aa, Vitis vinifera
MGGGNGQKSKMAREKNMEKQKNAARGSQLESNKKAMSIQCKVCMQTFICTTSEVKCREHAEAKHPKSDVYTCFPHLKK

SEQ ID NO: 6033 - protein, 78 aa, Populus trichocarpa
MGGGNGQKAKMARERNLDKQKAGSKGSQLEANKKAMSIQCKVCMQTFICTTSEVKCREHAEAKHPKSDVYACFPHLKK

SEQ ID NO: 6034 - protein, 78 aa, Populus trichocarpa
MGGGNGQKAKMAREKNLEKQKAGSKGSQLESNKKAMSIQCKVCMQTFICTTSEVKCREHAEAKHPKSDVNTCFPHLQK

SEQ ID NO: 6035 - protein, 78 aa, Populus trichocarpa
MGGGNGQKAKMAREKNLEKQKAGSKGSQLESNKKAMSIQCKVCMQTFICTTSEVKCREHAEAKHPKSDVYTCFPHLQK

SEQ ID NO: 6036 - protein, 77 aa, Populus trichocarpa
MGGGNGQKSKMARERNMEKQRAAKGSQLESNKKAMSIQCKVCMLTFICTTTEVKCREHAEAKHPKSDVYACFPHLKK

SEQ ID NO: 6037 - protein, 77 aa, Unknown
  Sequence found in Organisms: Solanum tuberosum, Solanum phureja
MGGGNGQKAKMAREKNMEKMKGQKGSQLEANKKAMNIQCKVCMQTFICTTSEVKCREHAEAKHPKSDVNACFPHLKK

SEQ ID NO: 6038 - protein, 78 aa, Glycine max
MGGGNAQKSKMAREKNLEKQKAAAKGSQLDSNKKAMSIQCKVCMQTFICTTSEVKCKEHAEAKHPKSDLYVCFPHLKK

SEQ ID NO: 6039 - protein, 78 aa, Glycine max
MGGGNGQKAKMAREKNLEKQKAASKGSQLDSNKKAMSIQCKVCMQTFMCTTSEVKCREHAEAKHPKSDVYACFPHLKK

SEQ ID NO: 6040 - protein, 78 aa, Fragaria vesca
MGGGNGQKAKMAREKAQEKAKNAGKGSQLETNKKAMSIQCKVCMQTFMCTTSEVKCREHAEAKHPKSDVYACFPHLKP

SEQ ID NO: 6041 - protein, 77 aa, Tamarix hispida
  misc_feature (11)..(11): Xaa can be any naturally occurring amino acid
MGGGNAQKSKXARERNLEKNKGAKGSQLEANKKAMNIQCKVCMQTFICTTSEVKCREHAEARHPKSDVTVCFPHLKK

SEQ ID NO: 6042 - protein, 77 aa, Solanum lycopersicum
MGGGNGQKAKMAREKNMEKMKGQKGSQLEANKKAMNIQCKVCMQTFICTTSEVKCREHAEAKHPKSDVYACFPHLQK

SEQ ID NO: 6043 - protein, 77 aa, Solanum lycopersicum
MGGGNGQKAKMAREKNMEKMKGQKGSQLEANKKAMNIQCKVCMQTFICTTSEVKCREHAEAKHPKSDVYACFPHLKK

SEQ ID NO: 6044 - protein, 77 aa, Juglans hindsii x Juglans regia
MGGGNGQKAKMAREKNLEKQKAAKGSQLETNKKAMSIQCKVCMQTFICTTTEVKCREHAEAKHPKSDVYTCFPHLKK

SEQ ID NO: 6045 - protein, 79 aa, Helianthus annuus
MGGEYAQKSKMARDKNLEKAKAAGKGSQLEANKIAMIIPRKVCMLTFICTTSEVKCREHAEAKHPKADVYACFPHLKKR

SEQ ID NO: 6046 - protein, 112 aa, Heritiera littoralis
YGRGKQIIEFESPLVSLRLNEIRVFEVRLLLAKSIRQGGNGQKSKMAREKNVEKAKAVKGSQLESNKKAMSIQCKVCMQTFMCTTSEVKCREHAEAKHPKSDLYACFPHLKK

SEQ ID NO: 6047 - protein, 86 aa, Gossypium hirsutum
YSRQIDQICGGGNAQKSKTAREGNLEKAKAGAKGSQLESNKKAMSIQCKVCMQEFMCTTSEVKCREHAEAKHPKSDVYACFPHLKK

SEQ ID NO: 6048 - protein, 67 aa, Populus trichocarpa
MARERNMEKQRAAKGSQLESNKKAMSIQCKVCMLTFICTTTEVKCREHAEAKHPKSDVYACFPHLKK

SEQ ID NO: 6049 - protein, 318 aa, Solanum tuberosum
MDSGENEVVVDFPHLIRVYKNGRVERLFGSPIVPPSPEDPATGVSSKDIDISLEFKARIYLPKLTNSTDQKLPILVYYHGGAFCLESAFSFLDHRYLNRIVAESNVIAVSVEYRLAPENPFPVAYEDSWAALQWVGSHVEAKPGFEKEPWLVDHGDFEKVLIGGDSAGGNIVHNLALRSGSESLNGGIKILGSLLCFPYFLTSIDFKEDSVPSKLWGFVNPSTKDGVDDPNINPFVEKAQSLSTLGCSKILVCVAEKDELRNIGIKYVEAVKNSEWKGEIELIDVEGEDHCFQIFDTETEKAKNLIKEIASFIKKSCV

SEQ ID NO: 6050 - protein, 76 aa, Brassica napus
GGGNAQKSKMAREKNLEKNKGSKGSQLEVNKKAMNIQCKVCMQTFICTTTEVKCREHAEAKHPKQDLYACFPHLKK

SEQ ID NO: 6051 - protein, 78 aa, Cyamopsis tetragonoloba
MGGGNAQKSKMARERNLDKQKAAAKGSQLETNKKAMSIQCKVCMQTFICTTTEVKCREHAEAKHPKSDLFTCFPHLKK

SEQ ID NO: 6052 - protein, 77 aa, Unknown
  Sequence found in Organisms: Ipomoea nil, Ipomoea batatas
MGGGNGQKSKMARERNNEKNKGAKGSQLDSNKKAMNIQCKVCMQTFMCTTSEVKCREHAEAKHPKADVTACFPHLKK

SEQ ID NO: 6053 - protein, 77 aa, Prunus persica
MGGGNGQKAKTARERNMEKQKAAKGSQLEANKKAMNIQCKVCMQTFICTTSEVKCREHAEAKHPKADVYSCFPHLKK

SEQ ID NO: 6054 - protein, 77 aa, Salvia sclarea
MGGGNGQKAKMARERNMEKLKGQKGSQLETNKKAMTIQCKVCMQTFICTTSEVKCREHAEAKHPKADVYACFPHLKK

SEQ ID NO: 6055 - protein, 78 aa, Unknown
  Sequence found in Organisms: Malus domestica, Prunus persica
MGGGNGQKAKMAREKNLEKQKAAGKGSQLKTNEKAMSIQCKVCMQAFMCTTSEVKCREHAEAKHPKSDVYACFPHLKK

SEQ ID NO: 6056 - protein, 77 aa, Persea americana
MGGGNGQKAKMARERNLEKQKGAKGSQLESNKKAMTIQCKVCMQTFICTTSEVKCREHAEAKHPKSDVSQCFPHLKK

SEQ ID NO: 6057 - protein, 77 aa, Ocimum basilicum
MGGGNGQKFKMARERNMEKLKGPKGSQLEANKKAMSIQCKVCMQTFICTTSEVKCREHAEAKHPKSDVYTCFPHLKK

SEQ ID NO: 6058 - protein, 78 aa, Phaseolus coccineus
MGGGNGQKSKMAREKNTEKQRAAAKGSQLDSNKKAMNIQCKVCMQTFMCTTSEVKCREHAEAKHPKSDLYACFPHLKK

SEQ ID NO: 6059 - protein, 78 aa, Manihot esculenta
MGGGNGQKAKMAREKHMEKQKAAGKGSQLESNKKAMNIQCKVCMQTFMCTTSEVKCREHAEAKHPKSDVSACFPHLKK

SEQ ID NO: 6060 - protein, 78 aa, Coffea canephora
MGGGNGQKSKMARERNLEKMKNAGKGSQLETNKKAMNIQCKVCMQTFMCTTSEVKCKEHAEAKHPKSDLNACFPHLKK

SEQ ID NO: 6061 - protein, 78 aa, Gossypium hirsutum
MGGGNAQKSKMAREKNLEKQKAAAKGSQLDSNKKAMTIQCKVCMQTFICTTTEVKCREHAEAKHPKSDLYTCFPHLKK

SEQ ID NO: 6062 - protein, 77 aa, Actinidia deliciosa
MGGGNGQKAKMAREKNLEKSKAAKGSQLETNKKAMSIQCKVCMQTFICTTSETKCKEHAEAKHPKAELYACFPHLKK

SEQ ID NO: 6063 - protein, 77 aa, Zea mays
MGGGNGQKSKMARERNLEKNKGAKGSQLETNKKAMSIQCKVCMQTFMCTTTEVKCREHAEAKHPKTDVYQCFPHLKK

SEQ ID NO: 6064 - protein, 77 aa, Elaeis guineensis
MGGGNGQKSKMAREKNMEKNKAPKGSQLESNKKAMTIQCKVCMQTFICTTSEVKCREHAEAKHPKSDLNQCFPHLKK

SEQ ID NO: 6065 - protein, 77 aa, Pinus taeda
MGGGNGQKAKMAREKNIEKNKPSKGSQLETNKKAMNIQCKVCMQTFICTTSEVKCREHAEAKHPKADVYQCFPHLKK

SEQ ID NO: 6066 - protein, 78 aa, Glycine max
MGGGNGQKAKMAREKNIEKQKAASKGSQLDSNKKAMSIQCKVCMQTFMCTTSEVKCREHAEAKHPKSDVYACFPHLKK

SEQ ID NO: 6067 - protein, 77 aa, Panicum virgatum
MGGGNGQKSKMARERNLEKNKAAKGSQLETNKKAMSIQCKVCMQTFMCTTTEVKCREHAEAKHPKSDVYQCFPHLKK

SEQ ID NO: 6068 - protein, 79 aa, Antirrhinum majus
MGGGNAQKAKMAREKNLEKAKGAKGSQLDANKKAMNIQCKICMQTFMCTTSEVKCREHAEAKHPKSDVGACFPHLKASA

SEQ ID NO: 6069 - protein, 78 aa, Musa acuminata
MGGGNGQKSKMARERNIEKNKGAKGSQLESNKKAMTIQCKVCMQTFICTTSEVKCREHAEAKHPKSDVSRCFPHLKKW

SEQ ID NO: 6070 - protein, 77 aa, Unknown
  Sequence found in Organisms: Hordeum vulgare, Pseudoroegneria spicata, Secale cereale
MGGGNAQKSKMARERNLEKLKGGKGSQLEANKKAMNIQCKICMQTFICTTSEAKCKEHAEAKHPKSDLVQCFPHLKQ

SEQ ID NO: 6071 - protein, 77 aa, Panax ginseng
MGGGNGQKAKMAREKNSEKNKSSKGSQLETNKKAMSIQCKVCMQTFICTTSDVKCREHAEAKHPKSEVEACFPHLKK

SEQ ID NO: 6072 - protein, 77 aa, Ipomoea nil
MGGGNGQKSKMARERNLEKNKGAKGSQLDSNKKAMNIQCKVCMQTFMCTTSEVKCREHAEAKHPKSDVGTCFPHLKK

SEQ ID NO: 6073 - protein, 78 aa, Cajanus cajan
MGGGNGQKAKMARERNLEKQKAGAKGSQLETNKKAMNIQCKVCMQTFMCTTSEVKCREHAEAKHPKSDVYACFPHLKK

SEQ ID NO: 6074 - protein, 77 aa, Musa acuminata
MGGGNGQKSKMARERNTEKNKAAKGSQLETNKKAMTIQCKVCMQTFMCTTSEVKCREHAEAKHPKSDVSQCFPHLKK

SEQ ID NO: 6075 - protein, 77 aa, Phaseolus coccineus
  misc_feature (69)..(69): Xaa can be any naturally occurring amino acid
MGGGNGQKSRMARERNMEKNKSSKGSQLEANKKAMNIQCKVCMQTFICTTSEVKCREHAEAKHPKVDLXACFPHLKK

SEQ ID NO: 6076 - protein, 77 aa, Manihot esculenta
MGGGNGQKAKMAREKNMEKQKAAKGSQLETNKKAMTIQCKVCMQTFICTTTEVKCREHAEAKHPKSDVYVCFPHLKK

SEQ ID NO: 6077 - protein, 77 aa, Glycyrrhiza uralensis
MGGGNGQKAKMAREKNLEKQKLSKGSQLDSNKKAMSIQCKVCMQTFMCTTSEVKCREHAEAKHPKSDVYTCFPHLKK

SEQ ID NO: 6078 - protein, 77 aa, Liriodendron tulipifera
MGGGNGQKAKMARERNSEKQKAAKGSQLESNKKAMSIQCKVCMQTFICTTSEVKCREHAEAKHPKTDVYQCFSHLKK

SEQ ID NO: 6079 - protein, 77 aa, Lotus japonicus
MGGGNGQKARMAREKHMEKLKSAKGSQLETNKKAMTIQCKVCMQTFICTTSEVKCREHAEAKHPKADLYACFPHLKK

SEQ ID NO: 6080 - protein, 77 aa, Zea mays
MGGGNGQKSKMARERNLEKNKGAKGSQLETNKKAISIQCKVCMQTFMCTTTEVKCREHAEAKHPKTDVYQCFPHLKK

SEQ ID NO: 6081 - protein, 77 aa, Nuphar advena
MGGGNGQKSRMAREKNLEKMKAPKGSQLETNKKAMSIQCKVCMQTFMCTTTEVKCREHAEAKHPKVDLYQCFPHLKK

SEQ ID NO: 6082 - protein, 77 aa, Elaeis guineensis
MGGGNGQKSKMAREKNMEKNKAPKGSQLESNKKAMTIQCKVCMQTFMCTTSEVKCREHAEAKHPKSDVYQCFTHLKK

SEQ ID NO: 6083 - protein, 78 aa, Carica papaya
MGGGNGQKSKMAREKNMEKQKAAAKGSQLDSNKKAMTIQCKVCMQTFMCTTSEVKCREHAEAKHPKSDMYACFPHLKK

SEQ ID NO: 6084 - protein, 77 aa, Arachis hypogaea
MGGGNGQKAKMAREKNLEKQKAAKGSQLDSNKKAMSIQCKVCMQTFMCTTSEVKCREHAEAKHPKSDVYVCFPHLKN

SEQ ID NO: 6085 - protein, 77 aa, Sesamum indicum
MGGGNGQKSRMARERNMEKLKAPKGSQLESNKKAMNIQCKVCMQTFICTTSEVKCKEHAEAKHPKADLYACFPHLKK

SEQ ID NO: 6086 - protein, 77 aa, Sorghum bicolor
MGGGNGQKSKMARERNLEKNKGSKGSQLETNKKAMSIQCKVCMQTFMCTTTEVKCREHAEAKHPKTDVYQCFPHLKK

SEQ ID NO: 6087 - protein, 77 aa, Saccharum officinarum
MGGGNGQKSKMARERNSEKNKAAKGSQLETNKKAMSIQCKVCMQTFMCTTTEVKCREHAEAKHPKTDVYQCFPHLKK

SEQ ID NO: 6088 - protein, 77 aa, Nicotiana tabacum
MGGGNGQKAKMAREKNLEKSKASKGSQLDTNKKAMSIQCKVCMQTFMCTTSEVKCKEHAEAKHPKSDLYACFPHLKK

SEQ ID NO: 6089 - protein, 77 aa, Gossypium hirsutum
MGGGNAQKSKMAREKNLEKQKAAAKGSQLDSNKKAMTICKVCMQTFICTTTEVKCREHAEAKHPKSDLYTCFPHLKK

SEQ ID NO: 6090 - protein, 65 aa, Cajanus cajan
MGGGNGQKAKMARERNLEKQKAGAKGSQLETNKKAMNIQCKVCMQTFMCTTSEVKCREHAEAKTP

SEQ ID NO: 6091 - protein, 79 aa, Cleome spinosa
MGGGNAQKSKMARERNLEKQKAAGKGSQLEKNKKAMTIQCKVCMQTFICTTTEVKCKEHAEARHPKSDLFACFPHLNNK

SEQ ID NO: 6092 - protein, 78 aa, Fagus grandifolia
MGGGNGQKAKMAREKNLEKQKGAKGSQLDSNKKAMTIQCKVCMQTFMCTTSEVKCREHAEAKHPKSDVTDCFPHLKKE

SEQ ID NO: 6093 - protein, 79 aa, Mimulus guttatus
MGGGNAQKAKMAREKNLEKLKAGGKGSQLDANKKAMSIQCKICMQTFICTTSEAKCKEHAEAKHPKAELLTCFPHLKKE

SEQ ID NO: 6094 - protein, 78 aa, Vaccinium corymbosum
MGGGNGQKAKMAREKNLEKSKAGAKGSQLETNKKAMSIQCKVCMQTFICTTSEVKCKEHAEAKHPKSDLHTCFPHLKA

SEQ ID NO: 6095 - protein, 77 aa, Cucumis sativus
MGGGNGQKAKMARERNLEKQKASRGSQLETNKKAMTIQCKVCMQTFICTTTEVKCREHAEARHPKSDVYACFPHLKK

SEQ ID NO: 6096 - protein, 77 aa, Unknown
  Sequence found in Organisms: Cucumis sativus, Cucumis melo
MGGGNGQKAKMARERNLEKQKGAKGSQLDSNKKAMTIQCKVCMQTFMCTTSEVKCREHAEAKHPKSDVFTCFPHLQK

SEQ ID NO: 6097 - protein, 78 aa, Solanum melongena
MGGGNGQKTKMARERNLEKLKGAAKGSQLDANKKAMNIQCKVCMQTFMCTTSEVKCKEHAEAKHPKSDLYACFPHLKK

SEQ ID NO: 6098 - protein, 77 aa, Avena sativa
MGGGNAQKSKMARERNLEKLKGGKGSQLEANKKAMNIQCKICMQTFICTTSEAKCKEHAEAKHPKSELVQCFPHLKQ

SEQ ID NO: 6099 - protein, 64 aa, Brassica juncea
KNLEKARQAGKGSQLEANKKAMSIQCKVCMQTFICTTSEVKCREHAEAKHPKADVVACFPHLKK

SEQ ID NO: 6100 - protein, 77 aa, Beta vulgaris
MGGGNAQKSKTARERNLEKNKASKGSQLDTNKKAMSIQCKVCMQTFMCTTTEVKCREHAEAKHPKHDITACFPHIQK

SEQ ID NO: 6101 - protein, 78 aa, Ricinus communis
MGGGNGQKAKTARERNMEKQKAAAKGSQLESNKKAMSIQCKVCMQTFICTTSEVKCREHAEAKHPKSDLFVCFPHLKK

SEQ ID NO: 6102 - protein, 78 aa, Ricinus communis
MGGGNGQKAKMAREKNLEKQKAAAKGSQLESNKKAMNIQCKVCMQTFMCTTSEVKCREHAEAKHPKSELYACFPHLKN

SEQ ID NO: 6103 - protein, 78 aa, Vigna unguiculata
MGGGNGQKSRMAREKNLEKQKAAAKGSQLDSNKKAMNIQCKVCMQTFMCTTSEVKCKEHAEAKHPKSDLYACFPHLKK

SEQ ID NO: 6104 - protein, 77 aa, Cryptomeria japonica
MGGGNGQKAKMAREKNNEKNKAPKGSQLETNKKAMTIQCKVCMQTFICTTSEVKCREHAEARHPKSDVSQCFPNLKK

SEQ ID NO: 6105 - protein, 77 aa, Unknown
  Sequence found in Organisms: Festuca arundinacea, Lolium multiflorum
MGGGNAQKSKMAREKNLEKLKGGKGSQLEANKKAMNIQCKICMQTFICTTSEAKCKEHAEAKHPKSELTQCFPHLKQ

SEQ ID NO: 6106 - protein, 77 aa, Zingiber officinale
MGGGNGQKSKTARERNLEKNKPTKGSQLESNKKAMNIQCKVCMQTFICTTSEVKCREHAEAKHPKNDVYQCFPHLKN

SEQ ID NO: 6107 - protein, 77 aa, Nuphar advena
  misc_feature (77)..(77): Xaa can be any naturally occurring amino acid
MGGGNGQKSKMSREKNLEKMKAPKGSQLETNKKAMSIQCKVCMQTFMCTTTEVKCREHAEAKHPKVDLYQCFPHLKX

SEQ ID NO: 6108 - protein, 77 aa, Oryza sativa
MGGGNGQKSKMARERNMEKNKGAKGSQLEANKKAMNIQCKICMQTFICTTSETKCKEHAEAKHPKSDLTACFPHLKK

SEQ ID NO: 6109 - protein, 77 aa, Glycine max
MGGGNGQKAKMARERNMEKNKPAKGSQLEANKKAMNIQCKVCMQTFICTTSEVKCREHAEAKHPKAHLYTCFPHLKN

SEQ ID NO: 6110 - protein, 83 aa, Antirrhinum majus
MGGGNGQKSRTARERNLEKMKPQKGSQLEANKKAMSIQCKVCMQTFICTTTEVKCREHAEARHPKADVFTCFPHLKPGAVQPA

SEQ ID NO: 6111 - protein, 79 aa, Eucalyptus gunnii
GAIGGGNGQKAKMAREKNLEKSKGSKGSQLESNKKAMNIQCKICMQTFMCTTSEVKCREHAEAKHPKSDVTACFPHLKK

SEQ ID NO: 6112 - protein, 80 aa, Medicago truncatula
MGGGNGQKAKMARERNLEKQKQAGKGSQLEKNKKAMSIQCKVCMQTFICTTSEVKCKEHAEARHPKSDLFTCFPHLKPEA

SEQ ID NO: 6113 - protein, 245 aa, Unknown
  Sequence found in Organisms: Solanum tuberosum, Solanum phureja
MAEKNGEVQEIKHQEVGHKSLLQSDALYQYILETSVYPREPESMKELREVTAKHPWNLMTTSADEGQFLNMLLKLINAKNTMEIGVYTGYSLLATALAIPEDGKILAMDINRENYEIGLPIIEKAGVSHKIDFREGPALPLLDQLLEDKNNHGTYDFIFVDADKDNYINYHKRIIELVKVGGLIGYDNTLWNGSVAAPADAPMRKYVRYYRDFVLELNKALAEDQRVEICMLPIGDGITLCRRII

SEQ ID NO: 6114 - protein, 240 aa, Nicotiana tabacum
MAENGIKHQEVGHKSLLQSDALYQYILETSVYPREPESMKELREVTAKHPWNLMTTSADEGQFLNMLLKLINAKNTMEIGVYTGYSLLATALAIPDDGKILAMDINRENYEIGLPIIEKAGVAHKIEFREGPALPVLDQLVEDKKNHGTYDFIFVDADKDNYINYHKRIIDLVKVGGLIGYDNTLWNGSVVAPPDAPMRKYVRYYRDFVLELNKALAVDPRIEICMLPVGDGITLCRRIT

SEQ ID NO: 6115 - protein, 240 aa, Nicotiana tabacum
MAENGIKHQEVGHKSLLQSDALYQYILETSVYPREPESMKELREVTAKHPWNLMTTSADEGQFLNMLLKLINAKNTMEIGVYTGYSLLATALAIPDDGKILAMDINRENYEIGLPIIEKAGVAHKIEFREGPALPVLDQLVEDKKNHGTYDFIFVDADKDNYINYHKRIIDLVKVGGLIGYDNTLWNGSVVAPPDAPMRKYVRYYRDFVLELNKALAVDPRIEICMLPVGDGITLCRRIS

SEQ ID NO: 6116 - protein, 245 aa, Solanum melongena
MAENGEKQVSKHQEVGHKSLLQSDALYQYILETSVYPREPGSMKELRELTAKHPWNLMTTSADEGQFLNMLLKLINAKNTMEIGVYTGYSLLATALALPHDGKILAMDINKENYEQIGLPVIQKAGVAHKIDFREGPALPVLDQLVEDKNNHGTYDFIFVDADKDNYLNYHKRIIELVKVGGLIGYDNTLWNGSVVAPPDAPMRKYVRYYRDFVLELNKALAADPRIEICMLPVGDGITLCRRIS

SEQ ID NO: 6117 - protein, 247 aa, Nicotiana tabacum
MAENGAAQENQVAKHQEVGHKSLLQSDALYQYILETSVYPREPEPMKELRELTAKHPWNLMTTSADEGQFLSMLLKLINAKNTMEIGVYTGYSLLATALALPHDGKILAMDINRENYEIGLPVIQKAGVAHKIDFREGPALPVLDLMVEDKNNHGTYDFIFVDADKDNYINYHKRIIELVKVGGVIGYDNTLWNGSVAAPPDAPMRKYVRYYRDFVLELNKALAADPRIEICMLPVGDGITLCRRIS

SEQ ID NO: 6118 - protein, 247 aa, Capsicum annuum
MAENGAAQENQVAKHQEVGHKSLLQSDALYQYILETSVYPREPEPMKELRELTAKHPWNLMTTSADEGQFLSMLLKLINAKNTMEIGVYTGYSLLATALALPDDGQILAMDINRENYELGLPIIQKAGVAHKIDFREGPALPVLDRLVEDKNNHGTYDFIFVDADKDNYINYHKRIIELVKVGGVIGYDNTLWNGSVVAPPDAPMRKYVRYYRDFVLELNKALAADPRIEICMLPVGDGITLCRRIS

SEQ ID NO: 6119 - protein, 248 aa, Solanum tuberosum
MAENVASQENQVSKHQEVGHKSLLQSDALYQYILETSVYPREPEPMKELRELTAKHPWNLMTTSADEGQFLNMLLKLINAKNTMEIGVYTGYSLLATALALPHDGKILAMDINKENYEEIGLPIIQKAGVAHKIDFREGPALPVLDLLVEDKNNHGTYDFIFVDADKDNYINYHKRIIELVKVGGVIGYDNTLWNGSVVAPPDAPLRKYVRYYRDFVLELNKALAADPRIEICMLPVGDGITLCRRIS

SEQ ID NO: 6120 - protein, 248 aa, Solanum lycopersicum
MAENVASQENQVSKHQEVGHKSLLQSDALYQYILETSVYPREPEPMKELRELTAKHPWNLMTTSADEGQFLNMLLKLINAKNTMEIGVYTGYSLLATALALPRDGKILAMDINKENYEEIGLPIIQKAGVAHKIDFREGPALPVLDLLVEDKNNHGTYDFIFVDADKDNYINYHKRIIELVKVGGVIGYDNTLWNGSVVAPPDAPLRKYVRYYRDFVLELNKALAADPRIEICMLPVGDGITLCRRIT

SEQ ID NO: 6121 - protein, 248 aa, Solanum phureja
MAENVASQENQVSKHQEVGHKSLLQSDALYQYILETSVYPREPEPMKELRELTAKHPWNLMTTSADEGQFLNMLLKLINAKNTMEIGVYTGYSLLATALALPHDGKILAMDINKENYEEIGLPIIQKAGVAHKIDFREGPALPVLDLLVEDKNNHGTYDFIFVDADKDNYINYHKRIIELVKVGGVIGYDNTLWNGSVVAPPNAPLRKYVRYYRDFVLELNKALAADPRIEICMLPVGDGITLCRRIS

SEQ ID NO: 6122 - protein, 247 aa, Nicotiana tabacum
MAENGAAQENQVTKHQEVGHKSLLQSDALYQYILETSVYPREPEPMKELRELTAKHPWNLMTTSADEGQFLSMLLKLINAKNTMEIGVYTGYSLLATALALPDDGKILAMDINKENYELGLPVIQKAGVAHKIDFREGPALPVLDLMIEDKNNHGTYDFIFVDADKDNYINYHKRIIELVKVGGVIGYDNTLWNGSVVAPPDAPMRKYVRYYRDFVLELNKALAADPRIEICMLPVGDGITLCRRIS

SEQ ID NO: 6123 - protein, 248 aa, Petunia hybrida
MAENGASQETTQVAKHQEVGHKSLLQSDALYQYILETSVYPREPEPMKELREITAKHPWNLMTTSADEGQFLNMLLKLINAKNTMEIGVYTGYSLLATALALPDDGKILAMDINRENYEIGLPVIQKAGVAHKIDFREGPALPVLDLMVEDKSNHGTYDFIFVDADKDNYINYHKRIIELVKVGGVIGYDNTLWNGSVVAPPDAPLRKYVRYYRDFVLELNKALAADPRIEICMLPVGDGITLCRRVS

SEQ ID NO: 6124 - protein, 244 aa, Artemisia annua
MATNGEAQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVDDVNFHGSFDFIFVDADKDNYLNYHKRLIDLVKVGGVIGYDNTLWNGSLVAPADAPLRKYVRYYRDFVLELNKALAVDSRVEICQLPVGDGITLCRRVC

SEQ ID NO: 6125 - protein, 244 aa, Artemisia annua
MATNGEAQPAKHQEVGHKSLLQSDALYQYILETSVYPREPESMKELREVTAKHPWNLMTTSADEGQFLNMLLKLINAKNTMEIGVYTGYSLLSTALALPEDGKILALDINRENYEIGLPIIEKAGVAHKIDFREGPALPLLDQMVDDVTFHGSFDFIFVDADKDNYLNYHKRLIDLVKIGGVIGYDNTLWNGSLVAPPDAPMRKYVRYYRDFVLELNKALAVDPRVEICQLPVGDGITLCRRIN

SEQ ID NO: 6126 - protein, 244 aa, Tropaeolum majus
MATNGEEQKSRHQEVGHKSLLQSDDLYQYILETSVYPREPESMKELREVTAKHPWNIMTTSADEGQFLNMLLKLINAKNTMEIGVYTGYSLLATALALPEDGKILAMDINRENYELGLPIIEKAGVAHKIEFREGPALPVLDLMLEDDKTHGTYDFIFVDADKDNYINYHKRLIDLVKVGGVIGYDNTLWNGSVVAPPDAPLRKYVRYYRDFVLELNKALAADPRIEICMLPVGDGITICRRIK

SEQ ID NO: 6127 - protein, 244 aa, Lactuca sativa
MAATGETQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMIEDAKFHGSFDFIFVDADKDNYLNYHKRLIDLVKIGGVIGYDNTLWNGSLVAPADAPLRKYVRYYRDFVLELNKALAADPRVEICQLPVGDGITLCRRIS

SEQ ID NO: 6128 - protein, 244 aa, Lactuca sativa
MATTGETQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMIEDAKFHGSFDFIFVDADKDNYLNYHKRLIDLVKIGGVIGYDNTLWNGSLVAPADAPLRKYVRYYRDFVLELNKALAADPRVEICQLPVGDGITLCRRIS

SEQ ID NO: 6129 - protein, 244 aa, Lactuca sativa
MAATGETQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVEDVKFHGSFDFIFVDADKDNYLNYHKRLIDLVKIGGVIGYDNTLWNGSLVAPADAPLRKYVRYYRDFVLELNKALAVDPRVEICQLPVGDGITLCRRIS

SEQ ID NO: 6130 - protein, 247 aa, Malus domestica
MAGNGEEQQTQAGRHQEVGHKSLLQSDALYQYILETSVYPREPESMKELREVTAKHPWNIMTTSADEGQFLNMLLKLINAKNTMEIGVYTGYSLLATALAIPDDGKILAMDINKENYELGLPIIEKAGVAHKIDFREGPALPVLDLLVEDKKNHGSFDFIFVDADKDNYINYHKRLIDLVKVGGLIGYDNTLWNGSVVAPPDAPLRKYVRYYRDFVLELNKALAADPRIEICMLPVGDGITLCRRIK

SEQ ID NO: 6131 - protein, 244 aa, Centaurea maculosa
MAANGETQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVDDVKFHGSFDFIFVDADKDNYLNYHKRLIDLVKIGGVIGYDNTLWNGSLVAPPDAPLRKYVRYYRDFVLELNKALAVDSRVEICQLPVGDGITLCRRVI

SEQ ID NO: 6132 - protein, 244 aa, Lactuca sativa
MAATGETQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVGDVKFHGSFDFIFVDADKDNYLNYHKRLIDLVKIGGVIGYDNTLWNGSLVAPADAPLRKYVRYYRDFVLELNKALAADPRVEICQLPVGDGITLCRRIS

SEQ ID NO: 6133 - protein, 244 aa, Lactuca sativa
  misc_feature (224)..(224): Xaa can be any naturally occurring amino acid
MAATGETQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVEDVKFHGSFDFIFVDADKDNYLNYHKRLIDLVKIGGVIGYDNTLWNGSLVAPADAPLRKYVRYYRDFVLELNKALAVDXRVEICQLPVGDGITICRRIS

SEQ ID NO: 6134 - protein, 244 aa, Lactuca sativa
MAATGETQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVEDVKFHGSFDFIFVDADKDNYLNYHKRLIDLVKIGGVIGYDNTLWNGSLVVPADAPLRKYVRYYRDFVLELNKALAADPRVEICQLPVGDGITLCRRIS

SEQ ID NO: 6135 - protein, 245 aa, Taraxacum officinale
MAATGELAQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVDDLSFHGSFDFIFVDADKDNYLNYHKRLIDLVKIGGVIGYDNTLWNGSLVAPADAPLRKYVRYYRDFVLELNKALAVDSRVEICQLPVGDGITLCRRIS

SEQ ID NO: 6136 - protein, 247 aa, Artemisia annua
MATVNSSSENQPAKHQEVGHKSLLQSDALYQYILETSVYPREPAPMKELREVTAKHPWNLMTTSADEGQFLNMLLKLINAKNTMEIGVYTGYSLLSTALALPEDGKILALDINRENYEIGLPIIEKAGVAHKIDFREGPALPLLDQMIEDEKFHGSFDFIFVDADKDNYLNYHKRLIDLVKVGGVIGYDNTLWNGSLVAPADAPLRKYVRYYRDFVLELNKALAVDPRVEICQLPVGDGITLCRRIS

SEQ ID NO: 6137 - protein, 244 aa, Lactuca sativa
MAATGETQPAKHQQVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVDDVKFHGSFDFIFVDADKDNYLNYHKRLIDLVKIGGVIGYDNTLWNGSLVAPADAPLRKYVRYYRDFVLELNKALAVDPRVEICQLPVGDGITLCRRIS

SEQ ID NO: 6138 - protein, 244 aa, Lactuca sativa
  misc_feature (113)..(113): Xaa can be any naturally occurring amino acid
MAATGETQPAKHQEVGHKSLLQSDALYQYILETSVYPREPESMKELREVTAKHPWNLMTTSADEGQFLNLLLKLINAKNTMEIGVYTGYSLLSTALALPEDGKILALDINREXYEIGLPIIEKAGVAHKIDFREGPALPLLDQMVEDVKFHGSFDFIFVDADKDNYLNYHKRLIDLVKIGGVIGYDNTLWNGSLVSPADAPLRKYVRYYRDFVLELNKALAVDPRVEICQLPVGDGITLCRRIS

SEQ ID NO: 6139 - protein, 244 aa, Senecio madagascariensis
MASTGETQPAKHQEVGHKSLLQSDALYQYILETSVYPREPESMKELREVTAKHPWNLMTTSADEGQFLNILLKLINAKNTMEIGVYTGYSLLSTALALPEDGKILALDINRENYEIGLPIIEKAGVAHKIDFREGPALPLLDQMVDDVKFHGSFDFIFVDADKDNYLNYHKRLIDLVKIGGVIGYDNTLWNGSLVAPPDAPLRKYVRYYRDFVLELNKALAADSRVEICQLPVGDGITLCRRIS

SEQ ID NO: 6140 - protein, 247 aa, Populus trichocarpa
MAANGEEQQTQAGRHQEVGHKSLLQSDALYQYILETSVYPREPECMKELRELTAKHPWNIMTTSADEGQFLNMLLKLINAKNTMEIGVYTGYSLLATALAIPEDGKILAMDINRENYELGLPVIQKAGLEHKIEFKEGPALPVLDQMIEDGKYHGTYDFIFVDADKDNYINYHKRLIELVKVGGLIGYDNTLWNGSVVAPADAPMRKYVRYYRDFVLELNKALAADPRIEICMLPVGDGITLCRRIK

SEQ ID NO: 6141 - protein, 245 aa, Taraxacum officinale
MAATGELAQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDEMVNDVKLHGSFDFIFVDADKDNYLNYHKRLIDLVKIGGVIGYDNTLWNGSLVAPADAPLRKYVRYYRDFVLELNKALAVDSRVEICQLPVGDGITLCRRIS

SEQ ID NO: 6142 - protein, 202 aa, Centaurea maculosa
MKELREVTAKHPWNLMTTSADEGQFLNMLLKLINAKNTMEIGVYTGYSLLSTALALPEDGKILALDINRENYEIGLPIIEKSGVAHKIDFREGPALPLLDEMVNDVKFHGSFDFIFVDADKDNYLNYHKRLIDLVKIGGVIGYDNTLWNGSLVAPADAPLRKYVRYYRDFVLELNKALAVDMRVEICQLPVGDGITLCRRIC

SEQ ID NO: 6143 - protein, 51 aa, Lactuca sativa
MAATGETQPAKDQEVGHESLLQSDALYQVHSPNQCLPERARIHERATRGHC

SEQ ID NO: 6144 - protein, 244 aa, Tragopogon dubius
MAATGEAQPAKHQEVGHKSLLQSDALYQYILETSVYPREPQSMKELREVTAKHPWNLMTTSADEGQFLNMLLKLINAKNTMEIGVYTGYSLLSTALALPEDGKILALDINRENYEIGLPIIEKAGVAHKIDFREGPALPLLDQMVDDVKLHGSFDFIFVDADKDNYLNYHKRLIDLIKIGGVIGYDNTLWNGSLVAPPDAPLRKYVRYYRDFVLELNKALAVDSRVEICQLPVGDGITLCRRIS

SEQ ID NO: 6145 - protein, 244 aa, Centaurea maculosa
  misc_feature (224)..(224): Xaa can be any naturally occurring amino acid
MAATGETQPAKHQEVGHKSLLQSDALYQYILETSVYPREPQSMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVDDVKFHGSFDFIFVDADKDNYLNYHKRLIDLVKIGGVIGYDNTLWNGSLVAPPDAPLRKYVRYYRDFVLELNKALAVDXRVEICQLPVGDGITLCRRIS

SEQ ID NO: 6146 - protein, 244 aa, Centaurea maculosa
MATTGETQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDEMIKDEKFHGSFDFIFVDADKDNYLNYHKRLIDLVKIGGVIGYDNTLWNGSLVAPPDAPLRKYVRYYRDFVLELNKALAADSRVEICQLPVGDGITLCRRIS

SEQ ID NO: 6147 - protein, 244 aa, Taraxacum officinale
MATTGEAQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDEMVGDVKLHGSFDFIFVDADKDNYLNYHKRLIDLVKIGGVIGYDNTLWNGSLVAPPDAPLRKYVRYYRDFVLELNKALAVDPRVEICQLPVGDGITLCRRIS

SEQ ID NO: 6148 - protein, 244 aa, Taraxacum officinale
MATTGEAQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDEMVGDVKLHGSFDFIFVDADKDNYLNYHKRLIDLVKIGGVIGYDNTLWNGSLVAPPDAPLRKYVRYYRDFVLELNKALAVDARVEICQLPVGDGITLCRRIS

SEQ ID NO: 6149 - protein, 244 aa, Lactuca sativa
MAATGEAQPAKHQEVGHKSLLQSDALYQYILETSVYPREPESMKELREVTAKHPWNLMTTSADEGQFLNMLLKLINAKNTMEIGVYTGYSLLSTALALPEDGKILALDINRENYEIGLPIIEKAGVAHKIDFREGPALPLLDEMVNDVKLHGSFDFIFVDADKDNYLNYHKRLIDLIKIGGVIGYDNTLWNGSLVAPPDAPLRKYVRYYRDFVLELNKALAVDPRVEICQLPVGDGITLCRRIS

SEQ ID NO: 6150 - protein, 242 aa, Fragaria vesca
ENGEEQKSRHQEVGHKSLLQSDALYQYILETSVYPREPECMKELRELTAKHPWNIMTTSADEGQFLNMLLKLINAKNTMEIGVYTGYSLLATALAIPEDGKILAMDINKENYELGLPVIEKAGVAHKIDFREGPALPVLDQMIEDEKNHGSFDFIFVDADKDNYINYHKRLIDLVKVGGLIGYDNTLWNGSVVAPPDAPLRKYVRYYRDFVLELNKALAADPRIEICMLPVGDGITLCRRIK

SEQ ID NO: 6151 - protein, 245 aa, Helianthus annuus
MAAATGETQPAKHQEVGHKSLLQSDALYQYILETSVYPREPQPMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVEDEKCHGSFDFIFVDADKDNYLNYHKRLIDLVKIGGVIGYDNTLWNGSLVAPPDAPLRKYVRYYRDFVLELNKALAVDPRVEICQLPVGDGITLCRRIS

SEQ ID NO: 6152 - protein, 244 aa, Helianthus annuus
MAAIGETQPAKHQEVGHKSLLQSDALYQYILETSVYPREPQPMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVDDVNFHGSFDFIFVDADKDNYLNYHKRLIDLVKIGGVIGYDNTLWNGSLVAPPDAPLRKYVRYYRDFVLELNKALAADTRVEICQLPVGDGITLCRRIC

SEQ ID NO: 6153 - protein, 247 aa, Populus trichocarpa
MAANGEEQQTQAGRHQEVGHKSLLQSDALYQYILETSVYPREPECMKELRELTAKHPWNIMTTSADEGQFLNMLLKLINAKNTMEIGVFTGYSLLATALAIPEDGKILAMDINRENYELGLPVIQKAGLEHKIEFKEGPALPVLDQMIEDGKYHGTYDFIFVDADKDNYINYHKRLIELVKVGGLIGYDNTLWNGSVVAPADAPMRKYVRYYRDFVLELNKALAADPRIEICMLPVGDGITLCRRIK

SEQ ID NO: 6154 - protein, 247 aa, Populus trichocarpa
MATNGEEQQSQAGRHQEVGHKSLLQSDALYQYILETSVYPREPECMKELREVTAKHPWNIMTTSADEGQFLNMLLKLVNAKNTMEIGVYTGYSLLATALAIPEDGKILAMDINRENYELGLPVIQKAGVAHKIDFKEGPALPVLDQMIEDGKCHGSFDFIFVDADKDNYINYHKRLIELVKVGGLIGYDNTLWNGSVVAPPDAPMRKYVRYYRDFVLELNKALAADPRIEICMLPVGDGITLCRRIQ

SEQ ID NO: 6155 - protein, 247 aa, Quercus alba
MATNAEGTQNEAGRHQEVGHKSLLQSDALYQYILETSVYPREPEPMKELREITAKHPWNIMTTSADEGQFLNMLLKLINAKNTMEIGVYTGYSLLATALALPEDGKILAMDINRENYELGLPVIEKAGVAHKIDFREGPALPALDLMVEDEKNHGAYDFIFVDADKDNYINYHKRLIELVKVGGVIGYDNTLWNGSVVAPPDAPLRKYVRYYRDFVLELNKALAADPRIEICMLPVGDGITICRRIK

SEQ ID NO: 6156 - protein, 247 aa, Unknown
  Sequence found in Organisms: Castanea mollissima, Quercus alba
MATNAEGTQNEAGRHQEVGHKSLLQSDALYQYILETSVYPREPEPMKELREITAKHPWNIMTTSADEGQFLNMLLKLINAKNTMEIGVYTGYSLLATALALPEDGKILAMDINRENYELGLPVIEKAGVAHKIDFREGPALPVLDLMVEDEKNHGAYDFIFVDADKDNYINYHKRLIELVKVGGVIGYDNTLWNGSVVAPPDAPLRKYVRYYRDFVLELNKALAADPRIEICMLPVGDGITICRRIK

SEQ ID NO: 6157 - protein, 247 aa, Actinidia deliciosa
MATNGESGQNQIHRHQEVGHKSLLQSDALYQYILETSVYPREPESMKELREVTAKHPWNIMTTSADEGQFLNMLLKLINAKNTMEIGVYTGYSLLATALALPDDGKILAMDINRENYELGLPIIEKAGLAHKIDFREGPALPVLDQMIEDGKFHGTYDFIFVDADKDNYLNYHKRLIDLVKVGGVIGYDNTLWNGSVVAPPDAPLRKYVRYYRDFVLELNKALAADPRIEICMLPVGDGITLCRRVS

SEQ ID NO: 6158 - protein, 247 aa, Prunus persica
MATNGADQQNQAGRHQEVGHKSLLQSDALYQYILETSVYPREPESMKELREVTAKHPWNIMTTSADEGQFLNMLLKLINAKNTMEIGVFTGYSLLATALAIPDDGKILAMDINRENYDLGRPIIEKAGVAHKIDFREGPALPVLDQLVEDEKNHGSYDFIFVDADKDNYINYHKRLIDLVKVGGLIGYDNTLWNGSVVAPPDAPLRKYVRYYRDFVLELNKALAADPRIEICMLPVGDGITLCRRIK

SEQ ID NO: 6159 - protein, 56 aa, Tragopogon dubius
MAATGEAQPAKHQEVGHKSLLQSDALYQYILETSVYPREPQSMKELREVTAKHPGI

SEQ ID NO: 6160 - protein, 77 aa, Lactuca sativa
MAATGETQPAKHQQVGHKSLLQSDALYQYILETSVYPREPQSMKELREVTAKHPWNLMTTSADEGQFFEPTSQAHKC

SEQ ID NO: 6161 - protein, 241 aa, Ipomoea batatas
MAENQTTRHQEVGHKSLLQSDALYQYILETSVYPREPEAMKELREVTAKHPWNLMTTSADEGQFLSMLLKLINAKNTMEIGVYTGYSLLATALAIPEDGKILAMDINRENYELGLPVIEKAGVAHKIEFKEGPALPVLDQLVEDPKNHGTYDFIFVDADKDNYLNYHKRLIDLVKVGGLIGYDNTLWNGSVVAPPDAPMRKYIKYYRDFVLELNKALAVDPRIEICMLPVGDGITLCRRIS

SEQ ID NO: 6162 - protein, 241 aa, Ipomoea nil
MAENQTTRHQEVGHKSLLQSDALYQYILETSVYPREPEAMKELREVTAKHPWNLMTTSADEGQFLSMLLKLINAKNTMEIGVYTGYSLLATALALPDDGKILAMDINRENYELGLPVIEKAGVAHKIDFREGPALPILDQLVEDPKKHGTYDFIFVDADKDNYLNYHKRLIDLVKVGGVIGYDNTLWNGSVVAPPDAPMRKYIKYYRDFVLELNKALAVDPRIEICMLPVGDGITLCRRIS

SEQ ID NO: 6163 - protein, 242 aa, Brassica juncea
EDKQSQNLRHQEVGHKSLLQSDELYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIN

SEQ ID NO: 6164 - protein, 241 aa, Ipomoea nil
  misc_feature (97)..(97): Xaa can be any naturally occurring amino acid
MAENQTTRHQEVGHKSLLQSDALYQYILETSVYPREPEAMKELREVTAKHPWNLMTTSADEGQFLSMLLKLINAKNTMEIGVYTGYSLLATALALPXDGKILAMDINRENYELGLPVIEKAGVAHKIDFREGPALPILDQLVEDPKKHGTYDFIFVDADKDNYLNYHKRLIDLVKVGGVIGYDNTLWNGSVVAPPDAPMRKYIKYYRDFVLELNKALAVDPRIEICMLPVGDGITLCRRIS

SEQ ID NO: 6165 - protein, 243 aa, Lactuca sativa
AATGEAQPAKHQEVGHKSLLQSDALYQYILETSVYPREPESMKELREVTARHPWNLMTTSADEGQFLNLLLKLINAKNTMEIGVYTGYSLLSTALALPEDGKILALDINRENYEIGLPIIEKAGVAHKIDFREGPALPLLDQMVDDVKFHGSFDFIFVDADKDNYLNYHKRLIDLVKIGGVIGYDNTLWNGSLVAPADAPLRKYVRYYRDFVLELNKALAVDPRVEICQLPVGDGITLCRRIS

SEQ ID NO: 6166 - protein, 245 aa, Helianthus annuus
MAAATGETQPAKHQEVGHKSLFQSDALYQYILETSVYPREPQPMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVEDEKCHGSFDFIFVDADKDNYLNYHKRLIDLVKIGGVIGYDNTLWNGSLVAPPDAPLRKYVRYYRDFVLELNKALAVDPRVEICQLPVGDGITLCRRIS

SEQ ID NO: 6167 - protein, 247 aa, Coffea canephora
MAQNGEGKDSQNLRHQEVGHKSLLQSDALYQYILETSVYPREPEPMKELRELTAKHPWNIMTTSADEGQFLNMIIKLINAKKTMEIGVYTGYSLLATALALPEDGKILAMDINRENYELGLPVIEKAGVSHKIDFREGPALPVLDELIEDDKNHGSFDFIFVDADKDNYLNYHKRIIELVKVGGMIGYDNTLWNGSVVAPPDAPMRKYVRYYRDFVLELNKALAADPRIEICMLPVGDGITLCRRVS

SEQ ID NO: 6168 - protein, 247 aa, Eucalyptus gunnii
  misc_feature (125)..(125): Xaa can be any naturally occurring amino acid
MAANAEPQQTQPAKHSEVGHKSLLQSDALYQYILETSVYPREPESMKELREITAKHPWNLMTTSADEGQFLNMLLKLINAKNTMEIGVYTGYSLLATALALPDDGKILAMDINRENFEIGLPVIXKAGLAHKIDFREGPALPLLDQLVQDEKNHGTYDFIFVDADKDNYINYHKRLIDLVKVGGLIGYDNTLWNGSVVAPADAPLRKYVRYYRDFVLELNKALAVDPRIEICMLPVGDGITLCRRVS

SEQ ID NO: 6169 - protein, 242 aa, Actinidia deliciosa
MATNGESEQNQTHRHQEVGHKSLLQSDALYQYILETSVYPREPESMKELREVTAKHPWNIMTTSADEGQFLNMLLKLINAKNTMEIGVYTGYSLLATALALPDDGKILAMDINRENYELGLPIIEKAGLAHKIDFREGPALPVLDQMIEDGKFHGTFDFIFVDADKDNYINYHKRLIDLVKVGGVIGYDNTLWNGSVVAPPDAPMRKYVRYYRDFVLELNKALAADPRIEICMLPVGDGITL

SEQ ID NO: 6170 - protein, 247 aa, Linum usitatissimum
MAEEQKSSSENVSRHQEVGHKSLLQSDALYQYILETSVYPREPESMKELREVTAKHPWNIMTTSADEGQFLNMLLKLVNAKNTMEIGVYTGYSLLATALAIPDDGKTLAMDINRENYEIGLPIIEKAGLAHKIEFREGPALPALDLMVENKSLHGTYDFIFVDADKDNYINYHKRLIDLVKIGGVIGYDNTLWNGSVVAPPDAPLRKYVRYYRDFVLELNKALAADPRIEICMLPVGDGITLCRRIS

SEQ ID NO: 6171 - protein, 247 aa, Unknown
  Sequence found in Organisms: Centaurea maculosa, Carthamus tinctorius
MAAVNGGSESQPAKHQEVGHKSLLQSDALYQYILETSVYPREPAPMKELREVTAKHPWNLMTTSADEGQFLNLLLKLINAKNTMEIGVYTGYSLLSTALALPDDGKILALDINRENYEIGLPIIEKAGVAHKIDFREGPALPLLDSMIEDKKFHGSFDFIFVDADKDNYLNYHKRLIDLVKIGGVIGYDNTLWNGSLVAPPDAPLRKYVRYYRDFVLELNKALAVDPRVEICQLPVGDGITLCRRIS

SEQ ID NO: 6172 - protein, 246 aa, Linum usitatissimum
MAEQQQSGENVSRHQEVGHKSLLQSDDLYQYILETSVYPREPESMKELREVTAKHPWNIMTTSADEGQFLNMLLKLINAKNTMEIGVYTGYSLLATALALPDDGKILAMDINRENYEIGLPIIEKAGLAHKIEFKEGPALPALDKMVEDKANHGAYDFIFVDADKDNYINYHKRLIDLVKIGGVIGYDNTLWNGSVVAPPDAPLRKYVRYYRDFVLELNKALAADPRIEICMLPVGDGITLCRRIS

SEQ ID NO: 6173 - protein, 244 aa, Artemisia annua
  misc_feature (149)..(149): Xaa can be any naturally occurring amino acid
  misc_feature (170)..(170): Xaa can be any naturally occurring amino acid
  misc_feature (179)..(179): Xaa can be any naturally occurring amino acid
  misc_feature (198)..(198): Xaa can be any naturally occurring amino acid
  misc_feature (202)..(203): Xaa can be any naturally occurring amino acid
  misc_feature (224)..(224): Xaa can be any naturally occurring amino acid
  misc_feature (239)..(239): Xaa can be any naturally occurring amino acid
  misc_feature (243)..(244): Xaa can be any naturally occurring amino acid
MATNGEAQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVDDVXFHGSFDFIFVDADKDNYLNYXKRLIDLVKXGGVIGYDNTLWNGSLVAPXDAPXXKYVRYYRDFVLELNKALAVDXRVEICQLPVGDGITXCRRXX

SEQ ID NO: 6174 - protein, 243 aa, Ocimum basilicum
MAENGEQQSRHQEVGHKSLLQSDALYQYILETSVYPNEPEPMKELREITANHPWNIMTTSADEGQFLNMLLKLINAKNTMEIGVYTGYSLLATALALPDDGKILAMDINRENYELGLPVIEKAGVAHKIDFREGPALPVLDQMVADGKYEGSFDFIFVDADKDNYLNYHKRLIELVKVGGVIGYDNTLWNGSVVAPPDAPLRKYVRYYRDFVLELNKALAADPRIEICQLPVGDGITLCRRII

SEQ ID NO: 6175 - protein, 239 aa, Lactuca sativa
ETQPGKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIQKAGVAHKIDFREGPALPLLDQMVEDVKFHGSFDFIFVDADKDNYLNYHKRLIDLVKIGGVIGYDNTLWNGSLVAPADAPLRKYVRYYRDFVLELNKALAVDPRVEICQLPVSDGITLCRRIS

SEQ ID NO: 6176 - protein, 244 aa, Lactuca sativa
MAATGEAQPAKHQEVGHKSLLQSDALYQYILETSVYPREPQPMKELREVTAKHPWNLMTTSADEGQFLNMLLKLINAKNTMEIGVYTGYSLLSTALALPEDGKILALDINRENYEIGLPIIEKAGVAHKIDFREGPALPLLDEMVNDVKLHGSFDFIFVDADKDNYLNYHKRLIDLIKIGGVIGYDNTLWNGSLVAPPDAPLRKYVRYYRDFVLELNKALAVDPRVEICQLPVGDGITLCRRIS

SEQ ID NO: 6177 - protein, 244 aa, Lactuca sativa
  misc_feature (78)..(78): Xaa can be any naturally occurring amino acid
  misc_feature (87)..(87): Xaa can be any naturally occurring amino acid
  misc_feature (103)..(103): Xaa can be any naturally occurring amino acid
  misc_feature (114)..(114): Xaa can be any naturally occurring amino acid
  misc_feature (135)..(135): Xaa can be any naturally occurring amino acid
MAATGEIQPAKHQEVGHKSLLQSDALYQYILETSVYPREPESMKELREVTAKHPWNLMTTSADEGQFLNLLLKLINAXNTMEIGVYXGYSLLSTALALPEDGXILALDINRENXEIGLPIIEKAGVAHKIDFREXPALPLLDQMIEDAKFHGSFDFIFVDADKDNYLNYHKRLIDLVKIGGVIGYDNTLWNGSLVAPADAPLRKYVRYYRDFVLELNKALAADPRVEICQLPVGDGITLCRRIS

SEQ ID NO: 6178 - protein, 245 aa, Zinnia violacea
MATPTGETQPAKHQEVGHKSLLQSDALYQYILETSVYPREPQPMKELRRITAKHPWNLMTTSADEGQFLNLLLKLINAKNTMEIGVYTGYSLLSTALALPEDGKILALDINRENYEIGLPIIQKAGVAHKIDFREGPALPLLDQMLQDEKCHGSFDFIFVDADKDNYLNYHKRLIDLVKFGGVIGYDNTLWNGSLVAPADAPLRKYVRYYRDFVLELNKALAVDPRVEICQLPVGDGITLCRRIS

SEQ ID NO: 6179 - protein, 250 aa, Brassica juncea
TKTSTTNGEDKQSQNLRHQEVGHKSLLQSDELYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIS

SEQ ID NO: 6180 - protein, 245 aa, Brassica juncea
TNGEDKQSQNLRHQEVGHKSLLQSDDLYQYILETSVYPREPESMKELREVTAKHPWNIMTTSADEGQFLHMLIKLVNAKNTMEIGVYTGYSLLATALALPEDGKILAMDVNRENYELGLPIIEKAGVAHKIDFREGPALPVLDELVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIN

SEQ ID NO: 6181 - protein, 247 aa, Triphysaria pusilla
MAQNGESVENQAGRHQEVGHKSLLQSDALYQYILETSVYPKEPESMKELREITAKHPWNIMTTSADEGQFLNMLLKLINAKNTMEIGVYTGYSLLATALALPDDGKILAMDINKENYELGLPVIEKAGVAHKIDFKEGPALPVLDQMIEEGKYHGTYDFIFVDADKDNYINYHKRLIDLVKVGGVIGYDNTLWNGSVVAAPDAPMRKYVRYYRDFVLELNKALAADPRIEICQLPVGDGITLCRRIS

SEQ ID NO: 6182 - protein, 247 aa, Glycine max
MAEQNQNQTTEAGRHQEVGHKSLLQSDALYQYILETSVYPREPESMKELRELTAKHPWNIMTTSADEGQFLNMLLKLINAKNTMEIGVYTGYSLLATALALPEDGKILAMDINRENYELGLPVIKKAGVDHKIEFREGPALPVLDEMVKDEKNHGSYDFIFVDADKDNYLNYHKRLIELVKVGGVIGYDNTLWNGSVVAPPDAPLRKYVRYYRDFVLELNKALAVDPRIEICMLPVGDGITICRRIK

SEQ ID NO: 6183 - protein, 247 aa, Glycine max
MAEQNQNQTTEAGRHQEVGHKSLLQSDALYQYILETSVYPREPESMKELRELTAKHPWNIMTTSADEGQFLNMLLKLINAKNTMEIGVYTGYSLLATALALPEDGKILAMDINRENYELGLPVIKKAGVDHKIEFREGPALPVLDEMIKDEKNHGSYDFIFVDADKDNYLNYHKRLIELVKVGGVIGYDNTLWNGSVVAPPDAPLRKYVRYYRDFVLELNKALAVDPRIEICMLPVGDGITICRRIK

SEQ ID NO: 6184 - protein, 274 aa, Ipomoea nil
  misc_feature (21)..(21): Xaa can be any naturally occurring amino acid
TNKTTKSALKKKKKKKLTATXCERKPRRENSKPWAENQTTRHQEVGHKSLLQSDALYQYILETSVYPREPEAMKELREVTAKHPWNLMTTSADEGQFLSMLLKSINAKNTMEIGVYTGYSLLATALAIPEDGKILAMDINRENYELGLPVIEKAGVAHKIEFKEGPALPVLDQLVEDPKNHATYDFIFVDADKDNYLNYHKRLIDLVKVGGLIGYDNTLWNGSVVAPPDAPMRKYIKYYRDFVLELNKALAVDPRIEICMLPVGDGITLCRRIS

SEQ ID NO: 6185 - protein, 244 aa, Lactuca sativa
  misc_feature (158)..(158): Xaa can be any naturally occurring amino acid
MAATGEAQPAKHQEVGHKSLLQSDALYQYILETSVYPREPKPMKELREVTAKHPWNLMTTSADEGQFLNMLLKLINAKNTMEIGVYTGYSLLSTALALPEDGKILALDINRENYEIGLPIIEKAGVAHKIDFREGPALPLLDEMVNDVKLHGSFDFIXVDADKDNYLNYHKRLIDLIKIGGVIGYDNTLWNGSLVAPPDAPLRKYVRYYRDFVLELNKALAVDPRVEICQLPVGDGITLCRRIS

SEQ ID NO: 6186 - protein, 249 aa, Cucumis melo
MASTTNGQEDQNQAGRHQEVGHKSLLQSDALYQYILETSVYPREPESMKELRELTAKHPWNIMTTSADEGQFLNMLLKLINAKKTMEIGVYTGYSLLATALALPEDGTILAMDINRENYELGLPVIEKAGVAHKIEFKEGPALPVLDDMVADKKNHGSYDFIFVDADKDNYINYHKRLIDLVKVGGVIGYDNTLWNGSVVAPPDAPMRKYVRYYRDFVLELNKALAADPRIEICMLPVGDGITLCRRIS

SEQ ID NO: 6187 - protein, 247 aa, Mimulus guttatus
MAENGEKAENQAGRHQEVGHKSLLQSDALYQYILETSVYPKEPESMKELREITAKHPWNIMTTSADEGQFLNMLLKLINAKNTMEIGVYTGYSLLATALALPHDGKILAMDINKENYELGLPVIQKAGVAHKIDFREGPALPVLDQMIADGKYHGTFDFIFVDADKDNYINYHKRLIDLVKVGGVIGYDNTLWNGSVVAPPDAPLRKYVRYYRDFVLELNKALAADPRIEICQLPVGDGITLCRRIS

SEQ ID NO: 6188 - protein, 247 aa, Orobanche aegyptiaca
MAQNGESVENQAGRHQEVGHKSLLQSDALYQYILETSVYPREPEAMKELREITAKHPWNIMTTSADEGQFLNMLLKLINAKNTMEIGVYTGYSLLATALALPDDGKILAMDINKDNYELGLPVIQKAGVAHKIDFREGPALPVLDQMIEEGKYHGTFDFIFVDADKDNYINYHKRLIDLVKVGGVIGYDNTLWNGSVVAPPDAPMRKYVRYYRDFVLELNKALAADPRIEICQLPVGDGITLCRRIS

SEQ ID NO: 6189 - protein, 247 aa, Vigna unguiculata
MANNGEQNQTEAGRHQEVGHKSLLQSDALYQYILETSVYPREPESMKELRELTAKHPWNIMTTSADEGQFLNMLLKLINAKNTMEIGVYTGYSLLATALALPDDGKILAMDINRENYELGLPVIKKAGVDHKIEFREGPALPVLDEMVKDEKNHGSYDFIFVDADKDNYINYHKRLIELVKVGGLIGYDNTLWNGSVVAPPDAPLRKYVRYYRDFVLELNKALAADPRIEICMLPVGDGITLCRRIK

SEQ ID NO: 6190 - protein, 247 aa, Artemisia annua
MAAVNNGSENQPAKHQEVGHKSLLQSDALYQYILETSVYPREPAPMKELREVTAKHPWNLMTTSADEGQFLNLLLKLINAKNTMEIGVYTGYSLLSTALALPDDGKILALDINRENYEIGLPIIEKAGVAHKIDFREGPALPLLDQMIADEKFHGSFDFIFVDADKDNYLNYHKRLIDLVKIGGVIGYDNTLWNGSLVAPADAPLRKYVRYYRDFVLELNKALAIDPRVEICQLPVGDGITLCRRVS

SEQ ID NO: 6191 - protein, 247 aa, Taraxacum officinale
MAAVNGGSESQPAKHQEVGHKSLLQSDALYQYILETSVYPREPAPMKELREVTAKHPWNLMTTSADEGQFLNLLLKLINAKNTMEIGVYTGYSLLSTALALPDDGKILALDINRENYEIGRPIIEKAGVAHKIDFREGPALPVLDLMIEDKKFHGSFDFIFVDADKDNYLNYHKRLIDLVKIGGVIGYDNTLWNGSLVAPPDAPLRKYVRYYRDFVLELNKALAVDPRVEICQLPVGDGITLCRRIN

SEQ ID NO: 6192 - protein, 244 aa, Cichorium intybus
MATTGEAQPAKHQEVGHKSLLQSDALYQYILETSVYPREPQPMKELREVTAKHPWNLMTTSADEGQFLNLLLKLINAKNTMEIGVYTGYSLLSTALALPEDGKILALDINRENYEIGLPIIEKAGVAHKIDFREGPALPLLDEMVNNVKLHGSFDFIFVDADKDNYLNYHKRLIDLIKIGGVIGYDNTLWNGSLVAPPDAPLRKYVRYYRDFVLELNKALAVDPRVEICQLPVGDGITLCRRIS

SEQ ID NO: 6193 - protein, 244 aa, Taraxacum officinale
MANTAEAQPAKHQEVGHKSLLQSDALYQYILETSVYPREPQSMKELREVTAKHPWNLMTTSADEGQFLNLLLKLINAKNTMEIGVYTGYSLLSTALALPDDGKILALDINRENYEIGLPIIEKAGVAHKIDFREGPALPLLDEMVNDAKLHGSFDFIFVDADKDNYLNYHKRLIDLIKIGGVIGYDNTLWNGSLVAPPDAPLRKYVRYYRDFVLELNKALAADPRVEICQLPVGDGITLCRRIS

SEQ ID NO: 6194 - protein, 242 aa, Capsicum annuum
MASNGENGRHQEVGHKSLLQSDALYQYILETSVYPREPEAMKELREITAKHPWNLMTTSADEGQFLNMLLKLINAKNTMEIGVFTGYSLLATAMALPDDGKILAMDINRENYEIGLPVIEKAGLAHKVDFREGPALPVLDQMIEDGKYHGSYDFIFVDADKDNYLNYHKRLIDLVKVGGLIGYDNTLWNGSVVAPPDAPLRKYVRYYRDFVLELNKALAADPRIEICQLPVGDGITLCRRIS

SEQ ID NO: 6195 - protein, 242 aa, Capsicum annuum
MASNGENGRHQEVGHKSLLQSDALYQYILETSVYPREPAPMKELREITAKHPWNLMTTSADEGQFLNMLLKLINAKNTMEIGVFTGYSLLATAMALPDDGKILAMDINRENYEIGLPVIEKAGLAHKIEFREGPALPVLDQMIEDGNYHGSYDFIFVDADKDNYLNYHKRLIDLVKVGGLIGYDNTLWNGSVVAPPDAPLRKYVRYYRDFVLELNKALAADPRIEICQLPVGDGITLCRRIS

SEQ ID NO: 6196 - protein, 242 aa, Solanum tuberosum
MASNGENGRHQEVGHKSLLQSDALYQYILETSVYPREPEAMKELREITAKHPWNLMTTSADEGQFLNMLLKLINAKNTMEIGVFTGYSLLATAMALPDDGKILAMDINRENYEIGLPVIEKAGLAHKIEFREGPALPVLDQMIEDGKYHGSYDFIFVDADKDNYLNYHKRLIDLVKVGGLIGYDNTLWNGSVVAPPDAPLRKYVRYYRDFVLELNKALAADPRIEICQLPVGDGITLCRRIS

SEQ ID NO: 6197 - protein, 242 aa, Solanum tuberosum
MASNGENGRHQEVGHKSLLQSDALYQYILETSVYPREPEAMKELREITAKHPWNLMTTSADEGQFLNMLLKLINAKNTMEIGVFTGYSLLATAMALPDDGKILAMDINRDNYEIGLPVIEKAGLAHKIEFREGPALPVLDQMIEDGKYHGSYDFIFVDADKDNYLNYHKRLIDLVKVGGVIGYDNTLWNGSVVAPPDAPLRKYVRYYRDFVLELNKALAADPRIEICQLPVGDGITLCRRIS

SEQ ID NO: 6198 - protein, 244 aa, Carthamus tinctorius
  misc_feature (99)..(99): Xaa can be any naturally occurring amino acid
  misc_feature (121)..(121): Xaa can be any naturally occurring amino acid
  misc_feature (178)..(178): Xaa can be any naturally occurring amino acid
  misc_feature (182)..(182): Xaa can be any naturally occurring amino acid
MAATGETQPAKHQEVGHKSLLQSDALYQYILETSVYPREPESMKELREVTAKHPWNLMTTSADEGQFLNLLLKLINAKNTMEIGVYTGYSLLSTALALXEDGKILALDINRENYEIGLPIXEKAGVAHKIDFREGPALPLLDQMVDDEKFHGSFDFIFVDADKDNYLNYHKRLIDLVXIGGXIGYDNTLWNGSLVAPPDAPLRKYVRYYRDFVLELNKALAADSRVEICQLPVGDGITLCRRVS

SEQ ID NO: 6199 - protein, 248 aa, Catharanthus roseus
MARNGEESKETQNLRHQEVGHKSLLQSDALYQYILETSVYPREPECMKELRELTAKHPWNIMTTSADEGQFLNMLIKLINAKNTMEIGVYTGYSLLATALALPEDGKILAMDINRENYELGLPVIEKAGVAHKIEFREGPALPVLDQMVEDSKNHGSYDFIFVDADKDNYLNYHKRLIDLVKVGGVIGYDNTLWNGSVVAPPDAPMRKYVRYYRDFVLELNKALAADPRIEICMLPVGDGITLCRRVS

SEQ ID NO: 6200 - protein, 248 aa, Arachis hypogaea
MASNGEQNQTSEAGRHQEVGHKSLLQSDALYQYILETSVYPREHEAMKELRELTAKHPWNLMTTSADEGQFLNMLLKLINAKNTMEIGVYTGYSLLATALALPEDGKILAMDINKENYELGLPVIKKAGVDHKITFKEGPALPVLDELVKDEKNHGNYDFIFVDADKDNYLNYHKRLIDLVKVGGVIGYDNTLWNGSVVAPADAPMRKYVRYYRDFVLELNKALAVDPRIEICMLPVGDGITLCRRIS

SEQ ID NO: 6201 - protein, 202 aa, Carthamus tinctorius
  misc_feature (173)..(173): Xaa can be any naturally occurring amino acid
MKELREVTAKHPWNLMTTSADEGQFLNLLLKLINAKNTMEIGVYTGYSLLSTALALPEDGKILALDINRENYEIGLPIIEKAGVAHKIDFREGPALPLLDEMIGDEKFHGSFDFIFVDADKDNYLNYHKRLIDLVKIGGVIGYDNTLWNGSLVAPPDAPLRKYVRYYRDFVLXLNKALAADSRVEICQLPVGDGITLCRRIS

SEQ ID NO: 6202 - protein, 247 aa, Theobroma cacao
MATNTQEQQSQAGRHQEVGHKSLLQSDALYQYILETSVYPREPEPMKELRELTAKHPWNLMTTSADEGQFLNMLLKLINAKNTMEIGVYTGYSLLATALALPDDGKILAMDINRENYELGLPVIQKAGVAHKIDFKEGPAMPALDQLVEDEKNHGSFDFVFVDADKDNYINYHKRLIELVKVGGLIGYDNTLWNGSVVAPPDAPLRKYVRYYRDFVLELNKALAADPRIEICMLPVGDGITLCRRVK

SEQ ID NO: 6203 - protein, 247 aa, Gossypium hirsutum
MATNTQEQQSQAGRHQEVGHKSLLQSDALYQYILETSVYPREPEPMKELRELTAKHPWNLMTTSADEGQFLNMLLKLINAKNTMEIGVYTGYSLLATALAIPDDGKILAMDVNRENYELGLPVIQKAGVAHKIDFKEGPALPVLDQLVEDEKNHGSFDFIFVDADKDNYLNYHKRLIELVKVGGLIGYDNTLWNGSVVAPPDAPLRKYVRYYRDFVMELNKALAVDPRIEICMLPVGDGITLCRRVK

SEQ ID NO: 6204 - protein, 247 aa, Cynara scolymus
  misc_feature (4)..(4): Xaa can be any naturally occurring amino acid
  misc_feature (28)..(28): Xaa can be any naturally occurring amino acid
MAAXNGGSESQPAKHQEVGHKSLLQSDXLYQYILETSVYPREPAPMKELREVTAKHPWNLMTTSADEGQFLNLLIKLINAKNTMEIGVYTGYSLLSTALALPDDGKILALDINRENYEIGLPIIEKAGVAHKIDFREGPALPVLDLMIEDKKFHGSFDFIFVDADKDNYLNYHKRLIDLVKIGGVIGYDNTLWNGSLVAPPDAPLRKYVRYYRDFVLELNKALAVDPRVEICQLPVGDGITLCRRIS

SEQ ID NO: 6205 - protein, 74 aa, Artemisia annua
MAAVNNGSENQPAKHQEVGHKSLLQSDALYQYILETSVYPREPAPMKELREVTAKHPWNLMTTSADEGQFLNFF

SEQ ID NO: 6206 - protein, 241 aa, Ocimum basilicum
ENGEQQSRHQEVGHKSLLQSDALYQYILETSVYPNEPEPMKELREITANHPWNIMTTSADEGQFLNMLLKLINAKNTMEIGVYTGYSLLATALALPDDGKILAMDINRENYELGLPVIEKAGVAHKIDFREGPALPVLDQMVADGKYEGSFDFIFVDADKDNYLNYHKRLIELVKVGGVIGYDNTLWNGSVVAPPDAPLRKYVRYYRDFVLELNKALAADPRIEICQLPVGDGITLCRRII

SEQ ID NO: 6207 - protein, 239 aa, Aquilegia formosa
QPQALRHQEVGHKSLLQSDALYQYILETSVYPREPQPMKELREITANHPWNLMTTSADEGQFLGMLLKLINAKNTMEIGVFTGYSLLATALALPEDGKILAMDINRENYEIGLPVIQKAGVAHKIDFREGPALPVLDQMLEDGKYHGTYDFIFVDADKDNYINYHKRLLDLVKVGGLIGYDNTLWNGSVVAPADAPMRKYVRYYRDFVIELNKALAADPRIEICQLPVGDGITLCRRIS

SEQ ID NO: 6208 - protein, 244 aa, Ocimum basilicum
MASNVENKESRHQEVGHKSLLQSDALYQYILETSVYPKEPEAMKELREITAKHPWNIMTTSADEGQFLNMLLKLMNAKNTMEIGVYTGYSLLATALALPHDGKILAMDINKENYELGLPVIEKAGVAHKIDFREGPALPVLDEMIKDSKNHGAFDFIFVDADKDNYLNYHKRLIELVKVGGVIGYDNTLWNGSVVAPPDAPLRKYVRYYRDFVLELNKALAADPRIEICQLPVGDGITLCRRIT

SEQ ID NO: 6209 - protein, 105 aa, Aquilegia formosa
MLFISIYLKLVYTQENHKPMKELREITANHPWNLMTTSADEGQFLNMLLKLINAKNTMEIGVFTGYSLLATALALPEDGKILAMDINRENYEIGLPVIEKGWSCS

SEQ ID NO: 6210 - protein, 242 aa, Lactuca sativa
MALDGETKTESGNEKQVSKHQEVGHKSLLQSDALYQYILETSVYPREPEPLKELREVTAKHPWNLMTTSADEGQFINMLLKLVNAKNTMEIGVFTGYSLLATALALPDDGKILAMDINRDNYELGRPIIEKAGVAHKIDFREGPALPVLDEMIADGKYHGTFDFVFVDADKDNYINYHKRLIDLVKVGGLIGYDNTLWNGSVVAPPDAPMRKYVRYYRDFVLELNKALAVDQRIEICMLPCW

SEQ ID NO: 6211 - protein, 246 aa, Cucumis sativus
TTNGQEDQNQAGRHQEVGHKSLLQSDALYQYILETSVYPREPESMKELRDLTAKHPWNIMTTSADEGQFLNMLLKLINAKKTMEIGVYTGYSLLATALALPEDGTILAMDINRENYELGLPVIEKAGVAHKIEFKEGPALPVLDDMVADKKNHGSYDFIFVDADKDNYINYHKRLIDLVKVGGVIGYDNTLWNGSVVAPPDAPMRKYVRYYRDFVLELNKALAADPRIEICMLPVGDGITLCRRIN

SEQ ID NO: 6212 - protein, 247 aa, Phaseolus coccineus
MANNGEQNQTEAGRHQEVGHKSLLQSDALYQYILETSVYPREPDSMKELRELTAKHPWNIMTTSADEGQFLNMLLKLINAKNTMEIGVYTGYSLLATALALPDDGKILAMDINRENYELGLPVIKKAGVDHKIEFREGPALPVLDEMITDEKNHGSYDFIFVDADKDNYINYHKRLIELVKVGGLIGYDNTLWNGSVVAPPDAPLRKYVRYYRDFVLELNKSLALDPRIEICMLPVGDGITLCRRIK

SEQ ID NO: 6213 - protein, 248 aa, Arachis hypogaea
MASNGEQNQTSEAGRHQEVGHKSLLQSDALYQYILETSVYPREHEAMKELRELTAKHPWNIMTTSADEGQFLNMLLKLINAKNTMEIGVYTGYSLLATALALPEDGKILAMDINKENYELGLPVIKKAGVDHKITFKEGPALPVLDELVKDEKNHGSYDFIFVDADKDNYLNYHKRLIDLVKVGGVIGYDNTLWNGSVVAPADAPMRKYVRYYRDFVLELNKALAVDPRIEICMLPVGDGITLCRRIS

SEQ ID NO: 6214 - protein, 247 aa, Juglans hindsii x Juglans regia
  misc_feature (166)..(166): Xaa can be any naturally occurring amino acid
MATNVEEKQNEAGRHQEVGHKSLLQSDALYQYILETSVYPREPEPMKELREVTAKHPWSIMTTSADEGQFLNMLIKLINAKNTMEIGVYTGYSLLATALALPEDGKILAMDINRENYELGLPVIEKAGVSHKIDFREGPALPVLDLMVEDEKNHGAYDFIFVDADXDNYLNYHKRLIELVKVGGLIGYDNTLWNGSVVAPPDAPLRKYVRYYRDFVLELNKALAADPRIEICMLPVGDGITLCRRIK

SEQ ID NO: 6215 - protein, 247 aa, Gossypium hirsutum
MATNTQDQQSQAGRHQEVGHKSLLQSDALYQYILETSVYPREPEPMKELRELTAKHPWNLMTTSADEGQFLNMLLKLINAKNTMEIGVYTGYSLLATALAIPDDGKILAMDVNRENYELGLPVIQKAGVAHKIDFKEGPALPVLDQLVEDEKNHGSFDFIFVDADKDNYLNYHKRLIELVKVGGLIGYDNTLWNGSVVAPPDAPLRKYVRYYRDFVMELNKALAVDPRIEICMLPVGDGITLCRRVK

SEQ ID NO: 6216 - protein, 247 aa, Helianthus annuus
MAAVNSGSDSQPAKHQEVGHKSLLQSDALYQYILETSVYPREPEPMKELREVTAKHPWNLMTTSADEGQFLNMLLKLINAKNTMEIGVYTGYSLLSTALALPDDGKILALDINRENYEIGLPIIQKAGVAHKIDFREGPALPLLDEMIKDEKFHGSFDFIFVDADKDNYLNYHKRLIDLVKIGGVIGYDNTLWNGSLVAPPDAPLRKYVRYYRDFVLELNKALAADTRVEICQLPVGDGITLCRRVS

SEQ ID NO: 6217 - protein, 242 aa, Solanum melongena
MASNGENGRHQEVGHKSLLQSDALYQYILETSVYPREPEAMKELREITAKHPWNIMTTSADEGQFLNMLLKLINAKNTIEIGVFTGYSLLATAMALPEDGKILAMDINRDNYEIGLPVIEKAGLAHKIEFREGPALPVLDQMIEDGKYHGSYDFIFVDADKDNYLNYHKRLIDLVKVGGLIGYDNTLWNGSVVAPPDAPLRKYVRYYRDFVLELNKALAADPRIEICQLPVGDGITLCRRIS

SEQ ID NO: 6218 - protein, 251 aa, Lactuca sativa
MAAVNSGGSEEVISQPAKHQEVGHKSLLQSDALYQYILETSVYPREPAPMKELREVTAKHPWNLMTTSADEGQFLNLLLKLINAKNTMEIGVYTGYSLLSTALALPDDGKILALDINRENYEIGLPIIEKAGVAHKIDFREGPALPVLDLMIEDEKFHGSFDFIFVDADKDNYLNYHKRLIDLVKIGGVIGYDNTLWNGSLVAPPDAPLRKYVRYYRDFVLELNKALAVDPRVEICQLPVGDGITLCRRIS

SEQ ID NO: 6219 - protein, 242 aa, Capsicum annuum
MASNGENGRHQEVGHKSLLQSDALYQYILETSVYPREPEAMKELREITAKHPWNLMTTSADEGQFLNMLLKLINAKNTMEIGVFTGYSLLATAMALPDDGKILAMDINRENYEIGLPVIEKAGLAHKIEFKEGPALPVLDQMIEDGKYHGSYDFIFVDADKDNYLNYHKRLIDLVKVGGLIGYDNTLWNGSVVAPPDATLRKYVRYYRDFVLELNKALAADPRIEICQLPVGDGITLCRRIG

SEQ ID NO: 6220 - protein, 242 aa, Petunia hybrida
MANNGENGRHQEVGHKSLLQSDALYQYILDTSVYPREPEPMKELREITAKHPWNIMTTSADEGQFLSMLLKLINAKNTMEIGVFTGYSLLATALALPDDGKILAMDINRENYEIGLPVIEKAGLAHKIEFKEGPALPVLDQMIEDGKYHGSYDFIFVDADKDNYLNYHKRLIDLVKVGGLIGYDNTLWNGSVVAPADAPLRKYVRYYRDFVLELNKALAADPRIEICQLPVGDGITLCRRIS

SEQ ID NO: 6221 - protein, 242 aa, Solanum lycopersicum
MATNGENGRHQEVGHKSLLQSDALYQYILETSVYPREPEAMKELREITAKHPWNLMTTSADEGQFLNMLLKLINAKNTMEIGVFTGYSLLATAMALPDDGKILAMDINRDNYEIGLPVIEKAGLAHKIEFREGPALPVLDQMIEDGQYHGSYDFIFVDADKDNYLNYHKRLIDLVKIGGLIGYDNTLWNGSVVAPPDAPLRKYVRYYRDFVLELNKALAADPRIEICQLPVGDGITLCRRIS

SEQ ID NO: 6222 - protein, 202 aa, Cynara scolymus
MKELREVTAKHPWNIMTTSADEGQFLNMLLKLVNAKNTMEIGVFTGYSLLATALALPDDGKILAMDINRDNYELGRPIIEKAGVAHKIDFKEGPAMPVLDEMIADGKYHGTYDFIFVDADKDNYINYHKRLIDLVKVGGLIGYDNTLWNGSVVAPPDAPMRKYVRYYRDYVLELNKALAADPRIEICMLPVGDGITLCRRIN

SEQ ID NO: 6223 - protein, 266 aa, Allium cepa
  misc_feature (238)..(239): Xaa can be any naturally occurring amino acid
  misc_feature (243)..(243): Xaa can be any naturally occurring amino acid
KLFVKGEEQEYMATTTTTTTAAAETQKGEQGRHQEVGHKSLLQSDALYQYILETSVYPREPESMKELREITAKHPWNLMTTSADEGQFLNMLLKLINAKNTMEIGVFTGYSLLATALAIPDDGKILAMDINRENYEIGLPVIEKAGVAHKIDFREGPALPVLDQMLEDEANKGSFDFIFVDADKDNYLNYHKRIIELVKVGGVIGYDNTLWNGSVVAPPDAPLRKYVRYYRDFVLELXXALAXDERIEILPLPWVMGYSFAQSNEL

SEQ ID NO: 6224 - protein, 250 aa, Lactuca sativa
MAAVNGSGSEEISQPAKHQEVGHKSLLQSDALYQYILETSVYPREPAPMKELREVTAKHPWNLMTTSADEGQFLNLLLKLINAKNTMEIGVYTGYSLLSTALALPDDGKILALDINRENYEIGLPIIEKAGVAHKIDFREGPALPVLDLMIEDEKFHGSFDFIFVDADKDNYLNYHKRLIDLVKIGGVIGYDNTLWNGSLVAPPDAPLRKYVRYYRDFVLELNKALAVDPRVEICQLPVGDGITLCRRIS

SEQ ID NO: 6225 - protein, 247 aa, Cyamopsis tetragonoloba
MATNGDQNQTTESRHQEVGHKSLLQSDALYQYILETSVYPREHEAMKELRELTAKHPWNIMTTSADEGQFLNMLLKLINAKNTMEIGVYTGYSLLATALALPEDGKILAMDINRENYELGLPVIKKAGVDHKIDFREGPALPVLDEMIQDETKLGSFDFIFVDADKDNYLNYHKRLIELVKVGGVIGYDNTLWNGSVVAPPDAPLRKYVRYYRDFVLELNKALAEDPRIEICQLPVGDGITLCRRIK

SEQ ID NO: 6226 - protein, 248 aa, Tragopogon dubius
MAAVNGGGSETQPAKHQEVGHKSLLQSDELYQYILETSVYPREPASMKELREVTAKHPWNLMTTSADEGQFLNLLLKLINAKNTMEIGVYTGYSLLSTALALPDDGKILALDINRENYDIGRPIIEKAGVAHKIDFREGPALPVLDQMIQDEKFHGSFDFIFVDADKDNYLNYHKRLIDLVKIGGVIGYDNTLWNGSLVAPPDAPLRKYVRYYRDFVLELNKALAVDPRVEICQLPVGDGITLCRRIS

SEQ ID NO: 6227 - protein, 247 aa, Helianthus annuus
MAAVNNGSDNQPAKHQEVGHKSLLQSDALYQYILETSVYPREPAPMKELREVTAKHPWNLMTTSADEGQFLNLLLKLINAKNTMEIGVYTGYSLLSTALALPDDGKILALDINRENYEIGLPIIEKAGVAHKIDFREGPALPVLDKMIEDEKFHGSFDFIFVDADKDNYLNYHKRLIDLVKIGGVIGYDNTLWNGSLVAPPDAPLRKYVRYYRDFVLELNKALAVDPRVEICQLPVGDGITLCRRVS

SEQ ID NO: 6228 - protein, 247 aa, Helianthus annuus
MAAVNDGSDNQPAKHQEVGHKSLLQSDALYQYILETSVYPREPAPMKELREVTAKHPWNLMTTSADEGQFLNLLLKLINAKNTMEIGVYTGYSLLSTALALPDDGKILALDINRENYEIGLPIIEKAGVAHKIDFREGPALPVLDKMIEDEKFHGSFDFIFVDADKDNYLNYHKRLIDLVKIGGVIGYDNTLWNGSLVAPPDAPLRKYVRYYRDFVLELNKALAVDPRVEICQLPVGDGITLCRRVS

SEQ ID NO: 6229 - protein, 242 aa, Solanum melongena
MSSNGENGRHQEVGHKSLLQSDALYQYILETSVYPREPEAMKELREITAKHPWNIMTTSADEGQFLNMLLKLINAKNTMEIGVFTGYSLLATAMALPDDGKILAMDINRDNYEIGLPVIEKAGLAHKIDFREGPALPVLDQMIEDGKYHGSYDFIFVDADKDNYLNYHKRLIDLVKVGGLIGYDNTLWNGSVVAPPDAPLRKYVRYYRDFVLELNKALAADPRIEICQLPVGDGITLCRRIS

SEQ ID NO: 6230 - protein, 242 aa, Vitis vinifera
MATNQEAGRHQEVGHKSLLQSDALYQYILETSVYPREPESMKELRELTAQHPWNIMTTSADEGQFLNMLLKLINAKNTMEIGVYTGYSLLATALALPDDGKILAMDINKENYELGLPVIQKAGVAHKIDFKEGPALPVLDQMIEDGKYHGSFDFIFVDADKDNYLNYHKRLIDLVKVGGIIGYDNTLWNGSVVAPPDAPLRKYVRYYRDFVLELNKALAADPRIEICMLPVGDGITLCRRLS

SEQ ID NO: 6231 - protein, 251 aa, Lactuca sativa
MAAVNSGGSDEIISQPAKHQEVGHKSLLQSDALYQYILETSVYPREPAPMKELREVTAKHPWNLMTTSADEGQFLNLLLKLINAKNTMEIGVYTGYSLLSTALALPDDGKILALDINRENYEIGLPIIEKAGVAHKIDFREGPALPVLDLMIEDEKFHGSFDFIFVDADKDNYLNYHKRLIDLVKIGGVIGYDNTLWNGSLVAPPDAPLRKYVRYYRDFVLELNKALAVDPRVEICQLPVGDGITLCRRIS

SEQ ID NO: 6232 - protein, 242 aa, Petunia hybrida
MATNGENGRHQEVGHKSLLQSDALYQYILETSVYPREPEPMKELREITAKHPWNLMTTSADEGQFLSMLIKLINAKNTMEIGVFTGYSLLATAMALPDDGKILAMDINRENYEIGLPVIEKAGLAHKIEFKEGPALPVLDQMIEDGKYHGSYDFIFVDADKDNYLNYHKRLIDLVKVGGLIGYDNTLWNGSVVAPPDAPLRKYVRYYRDFVLELNKALAADPRIEICQLPVGDGITLCRRIS

SEQ ID NO: 6233 - protein, 242 aa, Solanum phureja
MTSNGENSRHQEVGHKSLLQSDALYQYILETSVYPREPEAMKELREITAKHPWNLMTTSADEGQFLNMLLKLINAKNTMEIGVFTGYSLLATAMALPDDGKILAMDINRDNYEIGLPVIEKAGLAHKIEFREGPALPVLDQMIEDGKYHGSYDFIFVDADKDNYLNYHKRLIDLVKIGGVIGYDNTLWNGSVVAPPDAPLRKYVRYYRDFVLELNKALAADSRIEICQLPVGDGITLCRRIT

SEQ ID NO: 6234 - protein, 261 aa, Helianthus annuus
MALNGETKTESTNGEAKTESKNGEQVSRHQEVGHKSLLQSDALYQYILETSVYPREPEPMKELREVTAKHPWNIMTTSADEGQFLNMLLKLVNAKNTMEIGVFTGYSLLATALALPDDGKILAMDINRENYEMGLPIIEKAGVAHKIEFKEGPAMPILDEMIADEKYHGTFDFIFVDADKDNYINYHKRLIDLVKVGGLIGYDNTLWNGSVVSPPDAPMRKYVRYYRDFVLEFNKALSADARIEICMLPVGDGITLCRRIK

SEQ ID NO: 6235 - protein, 265 aa, Taraxacum officinale
  misc_feature (265)..(265): Xaa can be any naturally occurring amino acid
SLPLKSSLFNFLPPHQLITWRRHGGSESQPAKHQEVGHKSLLQSDALYQYILETSVYPREPAPMKELREVTAKHPWNLMTTSADEGQFLNLLLKLINAKNTMEIGVYTGYSLLSTALALPDDGKILALDINRENYEIGRPIIEKAGVAHKIDFREGPALPVLDLMIEDKKFHGSFDFIFVDADKDNYLNYHKRLIDLIKIGGVIGYDNTLWNGSLVAPPDAPLRKYVRYYRDFVLELNKALAVDPRVEICQLPVGDGITLCRRIX

SEQ ID NO: 6236 - protein, 242 aa, Lactuca sativa
MALDGETKTESGNEKQVSKHQEVGHKSLLQSDALYQYILETSVYPREPGPLKELREVTAKHPWNLMTTSADEGQFINMLLKLVNAKNTMEIGVFTGYSLLATALALPDDGKILAMDINRDNYELGRPIIEKAGVAHKIDFREGPALPVLDEMIADGKYHGTFDFVFVDADKDNYINYHKRLIDLVKVGGLIGYDNTLWNGSVVAPPDAPMRKYVRYYRDFVLELNKALAVDPRIEICMLPCW

SEQ ID NO: 6237 - protein, 261 aa, Eragrostis curvula
  misc_feature (200)..(200): Xaa can be any naturally occurring amino acid
  misc_feature (215)..(215): Xaa can be any naturally occurring amino acid
MASTATEAAVAQPEQQQQANGNGEQKTRHSEVGHKSLLKSDDLYQYILETSVYPREPESMRELREVTAKHPWNLMTTSADEGQFLNMLLKLIGAKKTMEIGVYTGYSLLATALAIPEDGTILAMDINRENYELGLPCIEKAGVAHKIDFREGPALPLLDQLLEDEANHGSFDFVFVDADKDNYLNYHERLMKLVKMGGLXGYDNTLWNGSVVLPXDAPMRKYIRYYRDFVLELNKALAADDRVEICQLPVGDGITLCRRVK

SEQ ID NO: 6238 - protein, 247 aa, Citrus sinensis
MASNAEDQQNQQGGHKEVGHKSLLQSDALYQYILETSVYPREAESMKELRELTAKHPWNVMTTSADEGQFLNMLLKLVNAKNTMEIGVYTGYSLLATALALPDDGKILAMDINRENYELGLPVIQKAGVAHKIDFREGPALPVLDLLIQDEKNHGSFDFIFVDADKDNYLNYHKRLIELVKVGGVIGYDNTLWNGSVVAPPDAPLRKYVRYYRDFVLELNKALAADPRIEICMLPVGDGVTICRRIK

SEQ ID NO: 6239 - protein, 247 aa, Vitis vinifera
MASNQEGQQNQAGRHQEVGHKSLLQSDALYQYILETSVYPREPKPMKELRELTAKHPWNIMTTSADEGQFLNMLLKLINAKNTMEIGVYTGYSLLATALALPDDGKILAMDINRENYELGLPIIEKAGLAHKIDFREGPALPVLDQMIEDGKYHGTFDFIFVDADKDNYLNYHKRLIDLVKVGGLIGYDNTLWNGSVVAPPDAPLRKYVRYYKDFVLELNKALAADPRIEICQLPVGDGITLCRRIS

SEQ ID NO: 6240 - protein, 247 aa, Medicago truncatula
MATNEDQNQTESGRHQEVGHKSLLQSDALYQYILETSVFPREHEAMKELREVTAKHPWNIMTTSADEGQFLSMLLKLINAKNTMEIGVYTGYSLLATALAIPEDGKILAMDINKENYELGLPVIKKAGVDHKIDFREGPALPVLDEMIKDEKNHGSYDFIFVDADKDNYLNYHKRLIDLVKVGGVIGYDNTLWNGSVVAPPDAPLRKYVRYYRDFVLELNKALAVDPRIEICMLPVGDGITICRRIK

SEQ ID NO: 6241 - protein, 260 aa, Persea americana
MATEVAATKQETETKTQGDGEQKAQFRHQEVGHKSLLQSDQLYQYILETSVYPREPECMKELRDITAKHPWNIMTTSADEGQFLNLLLKLINAKNTMEIGVYTGYSLLATALALPDDGKILAMDINRENYELGLPVIQKAGVSHKIEFREGPAMPVLDQMIEDKKYHGSYDFIFVDADKDNYINYHKRLIELVKVGGVIGYDNTLWNGSVVAPPDAPLRKYVRYYRDFVLELNKALAADPRIEICQLPVGDGITLCRRVS

SEQ ID NO: 6242 - protein, 272 aa, Persea americana
KSKRTNSSNSRKMATEVAATKQETETKTQGDGEQKAQFRHQEVGHKSLLQSDQLYQYILETSVYPREPECMKELRDITAKHPWNIMTTSADEGQFLNLLLKLINAKNTMEIGVYTGYSLLATALALPDDGKILAMDINRENYELGLPVIQKAGVSHKIEFREGPAMPVLDQMIEDKKYHGSYDFIFVDADKDNYINYHKRLIELVKVGGVIGYDNTLWNGSVVAPPDAPLRKYVRYYRDFVLELNKALAADPRIEICQLPVGDGITLCRRVS

SEQ ID NO: 6243 - protein, 243 aa, Ocimum basilicum
ASNVENKESRHQEVGHKSLLQSDALYQYILETSVHPKEPEAMKELREITAKHPWNIMTTSADEGQFLNMLLKLMNAKNTMEIGVYTGYSLLATALALPHDGKILAMDINKENYELGLPVIEKAGVAHKIDFREGPALPVLDEMIKDSKNHGAFDFIFVDADKDNYLNYHKRLIELVKVGGVIGYDNTLWNGSVVAPPDAPLRKYVRYYRDFVLELNKALAADPRIEICQLPVGDGITLCRRIT

SEQ ID NO: 6244 - protein, 242 aa, Nicotiana tabacum
MATNGENGRHQEVGHKSLLQSDALYQYILETSVYPREPEPMKELREITAKHPWNIMTTSADEGQFLSMLLKLINAKNTMEIGVFTGYSLLATAMALPDDGKILAMDINRDNYEIGLPVIEKAGLAHKIEFKEGPALPVLDQMIEDGKYHGSYDFIFVDADKDNYLNYHKRLIDLVKVGGLIGYDNTLWNGSVVAPPDAPLRKYVRYYRDFVLELNKALAADSRIEICQLPVGDGITLCRRIS

SEQ ID NO: 6245 - protein, 159 aa, Carthamus tinctorius
MEIGVYTGYSLLSTALALPEDGKILALDINRENYEIGLPIIEKAGVAHKIDFREGPALPLLDEMVNDGKFHGSFDFIFVDADKNNYLNYHKRLIDLVKIGGVIGYDNTLWNVSLVAPADAPLRKYVRYYKDFVLELNKALAVDMRVEICQLPVGDGITL

SEQ ID NO: 6246 - protein, 260 aa, Triticum aestivum
MATTAADATAAAPKEQPASTGGEQVTRHSEVGHKSLLQSDALYQYILETSVYPREHECMKELREITANHPWNLMTTSADEGQFLNMLLKLIGAKKTMEIGVYTGYSLLATALAIPEDGTILAMDINRENYELGLPCIEKAGVAHKIDFREGPALPVLDALLEDEANHGTFDFVFVDADKDNYLNYHERLMKLVKVGGLLGYDNTLWNGSVVLPADAPMRKYIRYYRDFVLDLNKALAADQRVEICQLPVGDGITLCRRAK

SEQ ID NO: 6247 - protein, 248 aa, Gossypium hirsutum
MATNTTQEQQSEAGRHQEVGHKSLLQSDALYQYMLETSVYPREPEPMKELRELTAKHPWNLMTTSADEGQFLNMLLKLINAKNTMEIGVYTGYSLLATALALPDDGKILAMDINRENYELGLPVIQKAGVAHKIEFKEGPAMPVLDKLVEDEKNHGSYDFIFVDADKDNYLNYHKRLIELVKVGGLIGYDNTLWNGSVVAPPDAPLRKYVRYYRDFVLELNKALAVDPRIEICMLPVGDGITLCRRVK

SEQ ID NO: 6248 - protein, 253 aa, Taraxacum officinale
MATIGEAQPAKHQEVGHKSLLQSDALYQYILETSVYPREPESMKELREVTAKHPWNLMTTSADEGQFLNLLLKLINAKNTMEIGVYTGYSLLSTALALPEDGKILALDINRENYEIGLPIIEKAGVAHKIDFREGPALPLLDEMVDDVKLHGSFDFIFVDADKDNYLNYHKRLIDLIKIGGVIGYDNTLWNGSLVAPPDAPLRKYVRYYRDFVLELNKALAVDPRVEICQLPVGDGITLCRRISKNTNYGPTL

SEQ ID NO: 6249 - protein, 246 aa, Eucalyptus gunnii
MATAGEESQTQAGRHQEVGHKSLLQSDALYQYILETSVYPREPEPMKELREITAKHPWNIMTTSADEGQFLNMLLKLINAKNTMEIGVFTGYSLLATALALPDDGKILAMDINRENYELGLPVIQKAGVADKIDFREGPALPILDQLIEDGKQGSFDFIFVDADKDNYLNYHKRLIELVKVGGLIGYDNTLWNGSVVAPPDAPLRKYVRYYRDFVLELNKALAADPRIEICMLPVGDGITLCRRIS

SEQ ID NO: 6250 - protein, 247 aa, Lotus japonicus
MATNEDQKQTEAGRHQEVGHKSLLQSDALYQYILETSVYPREHEAMKELRDLTAKHPWNIMTTSADEGQFLNMLLKLINAKNTMEIGVYTGYSLLATALAIPDDGKILAMDVNKENYELGLPVIKKAGVAHKIDFREGPALPVLDEMVKDEKNHGSYDFIFVDADKDNYLNYHKRLIELVKVGGVIGYDNTLWNGSVVAPPDAPLRKYVRYYRDFVLELNKALAVDPRIEICMLPVGDGITICRRIK

SEQ ID NO: 6251 - protein, 189 aa, Cichorium intybus
FTTSLFLPYHLISIKWRRFNGSESLPAKHQEVGHKSLLQSDAPYQYILETSVYPREPAPMKELREVTAKHPWNLMTTSADEGQFLNLLLKLINAKNTMEIGVYTGYSLLSTALALPDDGKILALDINRENYEIGRPIIEKAGVAHKIDFREGPALPVLDLMIEDEKFHGSFDFIFVNADKDNYLTTTRD

SEQ ID NO: 6252 - protein, 258 aa, Brassica rapa
MATTTTEATKTSPTNGEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIS

SEQ ID NO: 6253 - protein, 244 aa, Taraxacum officinale
MATTGEAQPIKHQESGHKSLLQSDALYQYILETSVYPREPESMKELREVTAKHPWNLMATSPDEGQFLSLLLKLINAKNTMEIGVYTGYSLLSTALALPEDGKILALDINRENYEIGLPVIEKAGVAHKIDFREGPALPLLDEMVNDVKLHGSFDFIFVDADKDNYLNYHIRLLDLVKIGGVIGYDNTLWSGSLVAPPDAPLKKYVRYYRDFVLELNKALAVDPRVEICQLPVADGITLCRRIS

SEQ ID NO: 6254 - protein, 245 aa, Zingiber officinale
MASENKDGEQHRHQEVGHKSLLQSDALYQYILETSVYPREPEPMKELRDITAKHPWNLMTTSADEGQFLGMLLKLINAKNTMEIGVYTGYSLLATALALPDDGKILAMDINRENFEIGLPVIQKAGVAHKIDFREGPALPVLDQLVEDAKNHGSFDFVFVDADKDNYINYHKRLLELVKVGGVIAYDNTLWNGSVVAPPDAPMRKYIRYYRDFVIELNKALAADERIEICQLPVGDGVTICRRVK

SEQ ID NO: 6255 - protein, 258 aa, Raphanus sativus
MATTTAEATKTSTNNGEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIS

SEQ ID NO: 6256 - protein, 258 aa, Raphanus sativus
MATTTTEATKTSPTNGEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIN

SEQ ID NO: 6257 - protein, 242 aa, Nicotiana tabacum
MATDGENGRHQEVGHKSLLQSDALYQYILETSVYPREPEPMKELREITAKHPWNLMTTSADEGQFLSMLIKLINAKNTMEIGVFTGYSLLATAMALPDDGKILAMDINRENYEIGLPVIEKAGLAHKIEFKEGPALPVLDQMIEDGKYHGSYDFIFVDADKDNYLNYHKRLIDLVKIGGLIGYDNTLWNGSVVAPPDAPLRKYVRYYRDFVLELNKALAADSRIEICQLPVGDGITLCRRIS

SEQ ID NO: 6258 - protein, 242 aa, Solanum lycopersicum
MASNGENGRHQEVGHKSLLQSDALYQYILETSVYPREPEAMKELREITAKHPWNLMTTSADEGQFLSMLLKLINAKNTMEIGVFTGYSLLATAMALPDDGKILAMDINRENYVIGLPVIEKAGLAHKIVFREGPALPVLDQMIDDGKYHGSYEFIFVDADKDNYLNYHKRLIDLVNVGGIIGYDNTLWNGSVVAPPDAPLRKYVRYYRDFVLELNKALAADPRIEICQLPVGDGITLCRRIS

SEQ ID NO: 6259 - protein, 260 aa, Pseudoroegneria spicata
MATTAADATAAVPKEQAASTGGEQVTRHSEVGHKSLLQSDALYQYILETSVYPREHECMKELREITANHPWNLMTTSADEGQFLNMLLKLIGAKKTMEIGVYTGYSLLATALAIPEDGTILAMDINRENYELGLPCIEKAGVAHKIDFREGPALPVLDALLEDEANHGTFDFVFVDADKDNYLNYHERLMKLVKVGGLLGYDNTLWNGSVVLPADAPMRKYIRYYRDFVLELNKALAADDRVEICQLPVGDGITLCRRAK

SEQ ID NO: 6260 - protein, 291 aa, Triticum aestivum
HPTNRLYKRSPDLGSFPSSNQASAMATTAADATAAVPKEQQPANGSAAATTGGEQVTRHSEVGHKSLLQSDALYQYILETSVYPREHECMKELREITANHPWNLMTTSADEGQFLNMLLKLIGAKKTMEIGVYTGYSLLATALAIPDDGTILAMDINRENYELGLPCIEKAGVAHKIDFREGPALPVLDALLEDEANHGTFDFVFVDADKDNYLNYHERLMKLVKVGGLLGYDNTLWNGSVVLPADAPMRKYIRYYRDFVLELNKALAADQRVEICQLPVGDGITLCRRAK

SEQ ID NO: 6261 - protein, 260 aa, Cleome spinosa
MATTVEATKKETSTNGDEQQQQSQALRHQEVGHKSLLQSDDLYQYILETSVYPREPESMKELREVTAKHPWNIMTTSADEGQFLNMLIKLVNAKNTMEIGVYTGYSLLATALALPDDGKILAMDINRENYELGLPIIQKAGVAHKIDFREGPALPVLDQLVADEKNRGSFDFIFVDADKDNYLNYHKRLIDLVKVGGVIGYDNTLWNGSVVAPPDAPMRKYVRYYRDFVIELNKALAADPRIEICMLPVGDGITICRRIN

SEQ ID NO: 6262 - protein, 247 aa, Carica papaya
MAANGEENQSQIGRHQEVGHKSLLQSDDLYQYILETSVYPREPEPMKELRELTAKHPWNIMSTSADEGQFLTMLLKLMNAKNTMEIGVYTGYSLLATALALPDDGKILAMDINKENYELGLPVIQKAGVAHKIEFGEGPAMPVLDEMLTDEKNHGSYDFIFVDADKDNYINYHKRLIDLVKVGGIIGYDNTLWNGSVAQPADAPMRKYVRYYRDFVLELNKALAADPRIDICMLPVGDGITLCRRIK

SEQ ID NO: 6263 - protein, 261 aa, Cynodon dactylon
MASTATEVAAQPAAAEQQVNGGGEQKTRHSEVGHKSLLKSDDLYQYILETSVYPREPESMKELREVTAKHPWNLMTTSADEGQFLNMLIKLIGAKKTMEIGVYTGYSLLATALAIPEDGTILAMDINRENYELGLPCIEKAGVAHKIDFREGPALPLLDQLLEDEANHGSFDFVFVDADKDNYLNYHERLMKLVKMGGLVGYDNTLWNGSVVLPADAPMRKYIRYYRDFVLELNKALAADERVEICQLPVGDGITLCRRVK

SEQ ID NO: 6264 - protein, 258 aa, Brassica juncea
MATTATEATKTSPTNGEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDELVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIN

SEQ ID NO: 6265 - protein, 247 aa, Mimulus guttatus
MAENVESKENQNGRHQEVGHKSLLQSDALYQYILETSVYPKEPEPMKELREITANHPWNIMTTSADEGQFLSMLLKLINAKNTMEIGVYTGYSLLATALALPHDGKILAMDINRENYELGLPVIKKAGVEHKIDFREGPALPVLDEMIQDGKYHGTFDFIFVDADKDNYINYHKRLIDLVKIGGVIGYDNTLWNGSVVAPPDAPLRKYVRYYRDFVLELNKALAADPRIEICQLPVGDGITLCRRLT

SEQ ID NO: 6266 - protein, 247 aa, Ocimum basilicum
MAENVESNEKQAGRHQEVGHKSLLQSDALYQYILETTVYPREHEAMKELREITAKHPWNIMTTSADEGQFLNMILKLINAKNTMEIGVYTGYSLLATALALPHDGKILAMDINRENYELGLPVIEKAGVAHKIDFREGPALPVLDELIKDSKKHGSFDFIFVDADKDNYLNYHKRLIELIKVGGLIGYDNTLWNGSVVAPPDAPLRKYVRYYRDFVLELNKALATDPRIEICQLPVGDGITLCRRLS

SEQ ID NO: 6267 - protein, 258 aa, Brassica napus
MATTTTEATKTSPTNGEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDELVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIN

SEQ ID NO: 6268 - protein, 247 aa, Trifolium pratense
MATNEDQKQTEAGRHAEVGHKSLLQSDALFQYILETSVFPREHEAMKELREVTAKHPWNIMTTSADEGQFLSMLLKLINAKNTMEIGVYTGYSLLATALALPEDGKILAMDINKENYELGLPVIKKAGVDHKIDFREGPALPVLDELIKDEKNHGSYDFIFVDADKDNYLNYHKRLIDLVKVGGVIGYDNTLWNGSVVAPPDAPLRKYVRYYRDFVLELNKALAVDPRIEICMLPVGDGITICRRIK

SEQ ID NO: 6269 - protein, 258 aa, Raphanus sativus
MATTTAETTKTSPTNGEDKQSQNLRHQEVGHKSLLQSDELYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDELVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIN

SEQ ID NO: 6270 - protein, 252 aa, Cichorium intybus
MAINGETKTESNNEQQVSRHQEVGHKSLLQSDALYQYILETSVYPREPEPMKELREVTAKHPWNLMTTSADEGQFLNILLKLVNAKNTMEIGVFTGYSLLATALALPDDGKILAMDINRDNYEVGRPIIEKAGVAHKIDFREGPALPLLDEMIADGKYHGTFDFIFVDADKDNYINYHTRLIDLVKVGGLIGYDNTLWNGSVVAPPDAPMRKYVRYYRDFVLELNKALAADPRIEICMLPVGDGITLCRRIN

SEQ ID NO: 6271 - protein, 262 aa, Brachypodium distachyon
MATTATDAAAATKEQTTNSAGGVGEQKTRHSEVGHKSLLQSDALYQYILETSVYPREHECMKELREVTANHPWNLMTTSADEGQFLNMLLKLIGAKKTMEIGVYTGYSLLATALALPADGTILAMDINRENYELGLPCIEKAGVAHKIDFREGPALPVLDALLEDERNHGSFDFVFVDADKDNYLNYHERLMRLVKVGGLLGYDNTLWNGSVVLPADAPMRKYIRYYRDFVLELNKALAADLRVEICQLPVGDGITLCRRVK

SEQ ID NO: 6272 - protein, 83 aa, Artemisia annua
MATNGETKTESTNGEQVSRHQEVGHKSLLQSDALYQYILETSVYPREPEAMKELREVTAKHPWNIMTTSAEAIFEHAIETSEC

SEQ ID NO: 6273 - protein, 266 aa, Hordeum vulgare
MATTAADATAAVPKDQAANGSAAASTGGEQVTRHSEVGHKSLLQSDALYQYILETSVYPREHECMKELREITANHPWNLMTTSADEGQFLNMLLKLIGAKKTMEIGVYTGYSLLATALAIPDDGTILAMDINRENYELGLPCIEKAGVAHKIDFREGPALPVLDALLEDEANHGTFDFVFVDADKDNYLNYHERLMKLVKVGGLLGYDNTLWNGSVVLPADAPMRKYIRYYRDFVLDLNKALAADQRVEICQLPVGDGITLCRRAK

SEQ ID NO: 6274 - protein, 242 aa, Ipomoea nil
MATNEETGRHQEVGHKSLLQSDALYQYILETSVYPREPETMKELREITANHPWNIMTTSADEGQFLNMLLKLIDAKNTMEIGVYTGYSLLATALALPHDGKILAMDINRENYELGLPVIQKAGVAHKIEFKEGPALPVLDQMIQDGKYQGSYDFIFVDADKDNYLNYHKRLIDLVKVGGLIGYDNTLWNGSVVAPADAPLRKYVRYYRDFVLELNKALADDPRIEICQLPVGDGITLCRRLY

SEQ ID NO: 6275 - protein, 232 aa, Citrus sinensis
MAKGHKSKLQSDALRQYILETSVYPREPESMKELREVTAKHPWNLMRTSADEGQFLNMSLKLINAKNTMEIGVYTDYSLLATALAIPDDGKILAMDINRENYEIGLPKIEKAGVAHRIQFREGPALPVLDQLVEDKKNHGTYDFIFVDADKDNYINYHKRIIDLVKVGGLIGYDNTLWNGSVVGPPDAPMRKYLRYCRDFVLELIKALAVDPRIEICMLPVGDGITLSRRIT

SEQ ID NO: 6276 - protein, 244 aa, Cynara scolymus
  misc_feature (4)..(4): Xaa can be any naturally occurring amino acid
  misc_feature (11)..(11): Xaa can be any naturally occurring amino acid
  misc_feature (22)..(22): Xaa can be any naturally occurring amino acid
  misc_feature (30)..(30): Xaa can be any naturally occurring amino acid
  misc_feature (34)..(34): Xaa can be any naturally occurring amino acid
  misc_feature (38)..(38): Xaa can be any naturally occurring amino acid
  misc_feature (44)..(45): Xaa can be any naturally occurring amino acid
  misc_feature (47)..(47): Xaa can be any naturally occurring amino acid
  misc_feature (243)..(243): Xaa can be any naturally occurring amino acid
MAAXGETQPAXHQEVGHKSLLXSDALYQYXLETXVYPXEPQSMXXLXEVTAKHPWNLMTTSADEGQFLNLLLKLINAKNTMEIGVYTGYSLLSTALALPDDGKILALDINRENYEIGLPIIEKAGVAHKIDFREGPALPLLDQMVDDVKFHGSFDFIFVDADKDNYLNYHKRLIDLVKIGGVIGYDNTLWNGSLVAPPDAPLRKYVRYYRDFVLELNKALAVDPRVEICQLPVGDGITLCRRXS

SEQ ID NO: 6277 - protein, 189 aa, Lactuca sativa
  misc_feature (13)..(13): Xaa can be any naturally occurring amino acid
MAAVNSGGSEEIXQPAKHQEVGHKSLLQSDALYQYILETSVYPREPAPMKELREVTAKHPWNLMTTSADEGQFLNLLLKLINAKNTMEIGVYTGYSLLSTALALPDDGKILALDINRQNYEIGLPIIEKAGVAHKIDFREGPALPVLDLMIEDEKFHGSFDFIFVDADKDNYLNYHKRLIDQDWWRNWL

SEQ ID NO: 6278 - protein, 249 aa, Taraxacum officinale
MAIDGETNNEQKQVSRHQEVGHKSLLQSDALYQYILETSVYPREPEPLKELREVTAKHPWNLMTTSADEGQFLNMLLKLVNAKNTMEIGVFTGYSLLATALALPDDGKILAMDINRDNYELGRPIIEKAGVAHKIDFREGPALPVLDEMIADGKYHGTFDFIFVDADKDNYINYHTRLIDLVKVGGLIGYDNTLWNGSVVAPPDAPMRKYVRYYRDFVLELNKALAVDPRIEICMLPVGDGITLCRRNS

SEQ ID NO: 6279 - protein, 247 aa, Quercus alba
MAPTQEEQQNEAGRHQEVGHKSLLQSDALYQYILETSVYPKEPEPMKELRELTARHPWNIMTTSADEGQFLNMILKLINAKNTMEIGVYTGYSLLATALALPEDGKILAMDINRENYELGLPVIQKAGVAHKIDFKEGPALPVLDQMIESGTYHGTFDFIFVDADKDNYLNYHERLIELVKVGGLIGYDNTLWNGSVVAPPDAPLRKYVRFYRDYVLELNRALASDRRVEICQLPVGDGITLCRRIS

SEQ ID NO: 6280 - protein, 247 aa, Theobroma cacao
MAPTQEGRQNQAGRHQEVGHKSLLQSDNLYQYILETSVYPREPEPMKELRELTAKHPWNIMTTSADEGQFLNMLLKLINAKNTMEIGVYTGYSLLATALALPDDGKILAMDINRENYELGLPVIQKAGVAHKIDFKEGPSLPVLDQMIEAGKYHGTFDFIFVDADKDNYLNYHKRLIELVKVGGVIGYDNTLWNGSVVAPPDAPLRKYVLYYRDFVLELNRALAADPRIEICQLPVGDGITLCRRIS

SEQ ID NO: 6281 - protein, 258 aa, Brassica napus
MATTTTEATKTSPTNGEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDELVADEKNHGTYDFIFVDADKDNYINYHKRLIDLVKVGGVIGYDNTLWNGSVVAPPDAPMRKYVRYYRDFVIELNKALAADPRIEICMLPVGDGITICRRIN

SEQ ID NO: 6282 - protein, 243 aa, Glycyrrhiza uralensis
MATNEDQKQTEAGRHQEVGHKSLLQSDALYQYILETSVYPREHEAMKELRELTAKHPWNIMTTSADEGQFLNMLLKLINAKNTMEIGVYTGYSLLATALALPEDGKILAMDVNRENYELGLPVIKKAGVAHKIDFREGPALPVLDEMVKDEKNHGSFDFIFVDADKDNYLNYHKRLIELVKVGGVIGYDNTLWNGSVVAPPDAPLRKYVRYYRDFVLELNKALAVDPRIEICMLPVGDGITIC

SEQ ID NO: 6283 - protein, 187 aa, Centaurea maculosa
MTTSADEGQFLNMLLKLVNAKNTMEIGVFTGYSLLATAPAPPEDGKILAMDINRDNHELGLPIIEKAGVAHKIDFKEGPAVPVLDEMIANGKYHGTYDFIFVDADKDNYINYHKRLIDLVKVGGLIGYDNTLWNGSVAAPPDAPVRKYVRYYRDFVLEFNKALGADLRIEICMLPVGDGITLCRRIN

SEQ ID NO: 6284 - protein, 242 aa, Unknown
  Sequence found in Organisms: Ipomoea nil, Ipomoea batatas
MATNGENGRHREVGHKSLLQSDALYQYILETSVYPREPQAMKELREITANHPWNIMTTSADEGQFLNMLLKLINAKNTMEIGVYTGYSLLATALALPHDGKILAMDINRENYELGLPVIQKAGVAHKIEFKEGPALPVLDQMIQDGKYQGSYDFIFVDADKDNYLNYHKRLIDLVKVGGLIGYDNTLWNGSVVAPADAPLRKYVRYYRDFVLELNKELAADPRIEICQLPVGDGITLCRRVY

SEQ ID NO: 6285 - protein, 255 aa, Cichorium intybus
IQLKHTADPLQWPPPSETQPAKHQEVGHKSLLQSDALYQYILETSVYPREPESMKELREVTDKHPWNLMTTSADEGQVLNLLLKLINAKNTMEIGVYTGYSLLSTALALPEDGKILALDINRENYEIGLPIIEKAGVAHKIDFREGPALPLLDQMVDDVKFHGSFDFIFVDADKDNYLNYHKRLIDLVKIGGVIGYDNTLWNGSLVAPADAPLRKYVRYYRDFVLELNKALAVDPRVEICQLPVGDGITLCRRIS

SEQ ID NO: 6286 - protein, 250 aa, Gossypium hirsutum
MATNKTEEQQQQSQAGRHQEVGHKSLLQSDALYQYILETSVYPREPEPMKELREITAKHPWNLMTTSADEGQFLNMLLKLINAKNTMEIGVYTGYSLLATALAVPDDGKILAMDINRENYELGLPVIQKAGVAHKIDFKEGPAMPVLDELVQDEKNHGSFDFIFVDADKDNYLNYHKRLIELVKVGGLIGYDNTLWNGSVVAPPDAPLRKYVRYYRDFVLELNKALAVDPRIEICMLPVGDGITLCRRLK

SEQ ID NO: 6287 - protein, 249 aa, Acacia harpophylla
MASSNGEEKKQSEAGRHQEVGHKSLLQSDALYQYILETSVYPREPEPMKELREITAKHPWNIMTTSADEGQFLNMLLKLINAKNTMEIGVYTGYSLLATALALPDDGKILAMDINRENYELGRPTLEKAGVAHKVDFREGPALPFLDELVKDEKNHGSFDFIFVDADKDNYLNYHERLLQLVKVGGVIGYDNTLWNGSVVAPDDAPLRKYVMYYREFVLKLNKALAVDPRIEICMLPVGDGITLCRRIK

SEQ ID NO: 6288 - protein, 258 aa, Raphanus sativus
  misc_feature (114)..(114): Xaa can be any naturally occurring amino acid
MATTTTEATKTSPTNEEDKRSQNLRHQEVGHKSLLQSDDLYQYILETSVYPREPESMKELREVTAKHPWNIMTTSADEGQFLNMLIKLVNAKNTMEIGVYTGYSLLATALALPXDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIN

SEQ ID NO: 6289 - protein, 246 aa, Manihot esculenta
MASNNEQQNQAGRHQEVGHKSLLQSDELYQYILETSVYPREPEPMKELRELTAKHPWNIMTTSADEGQFLNMILKLMNAKNTMEIGVYTGYSLLATALALPDDGKILAMDINRENYELGLPVIQKAGVAHKIDFKEGPALPVLDQMIAEGKYHGTFDFIFVDADKDNYLNYHKRLIELVKVGGVIGYDNTLWNGSVVAPPDAPLRKYVKYYRDFVMELNKALPADPRIEICMLPVGDGITLCRRIK

SEQ ID NO: 6290 - protein, 252 aa, Lactuca sativa
MALDGETKTESGNEKQVSKHQEVGHKSLLQSDALYQYILETSVYPREPEPMKELREVTAKHPWNLMTTSADEGQFIHMLLKLVNAKNTMEIGVFTGYSLLATALALPDDGKILAMDINRDNYELGRPIIEKAGVAHKIDFREGPALPVLDEMIADGKYHGTFDFIFVDADKDNYINYHKRLIDLVKVGGLIGYDNTLWNGSVVAPPDAPMRKYVRYYRDFVLELNIALAVDPRIEICMLPVGDGITLCRRIN

SEQ ID NO: 6291 - protein, 252 aa, Lactuca sativa
MALDGETKTESGNEKQVSKHQEVGHKSLLQSDALYQYILETSVYPREPEPLKELREVTAKHPWNLMTTSADEGQFINMLLKLVNAKNTMEIGVFTGYSLLATALALPDDGKILAMDINRDNYELGRPIIEKAGVAHKIDFREGPALPVLDEMIADGKYHGTFDFVFVDADKDNYINYHKRLIDLVKVGGLIGYDNTLWNGSVVAPPDAPMRKYVRYYRDFVLELNKALAVDPRIEICMLPVGDGITLCRRIN

SEQ ID NO: 6292 - protein, 243 aa, Brassica napus
MATTTAEATKTSSTNVEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELNRLLLLTLGLRFA

SEQ ID NO: 6293 - protein, 103 aa, Gerbera hybrid cultivar
MAAVNSGNDGSQPAQHQEMGHKSLLQSDALYQYILETSVYPREPAPMKELREVTARHPWSLMTTSADEGQFLNLLLKLINAKNTMGDWCLHWLFSFVHGSRSA

SEQ ID NO: 6294 - protein, 250 aa, Gossypium hirsutum
MATNKTEEQQQQSQAGRHQEVGHKSLLQSDALYQYILETSVYPREPEPMKELREITAKHPWNLMTTSADEGQFLNMLLKLINAKNTMEIGVYTGYSLLATALAVPDDGKIFAMDINRENYELGLPVIQKAGVAHKIDFKEGPAMPVLDELVQDEKNHGSFDFIFVDADKDNYLNYHKRLIELVKVGGLIGYDNTLWNGSVVAPPDAPLRKYVRYYRDFVLELNKALAVDPRIEICMLPVGDGITLCRRLK

SEQ ID NO: 6295 - protein, 250 aa, Papaver somniferum
MAATNQDEQQTTTQALRHQEVGHKSLLQSDELYQYILETSVYPREPESMKELREITANHPWNIMTTSADEGQFLNMLLKLINAKNTMEIGVYTGYSLLATALALPDDGKILAMDINKENYELGLPVIQKAGVAHKIEFREGPAMPVLDQMVEDKKFHGSYDFIFVDADKDNYINYHKRLIDLVKIGGVIGYDNTLWNGSVVAPADAPMRKYVRYYRDFVIELNKALAADPRIEICQLPVGDGITLCRRVS

SEQ ID NO: 6296 - protein, 285 aa, Triticum aestivum
ITHPTNHLCTRSPDLGPFPSSDQAPAMATTAADATAAAPKDQPANGSEQVTRHSEVGHKSLLQSDALYQYILETSVYPREHECMKELREITANHPWNLMTTSADEGQFLNMLLKLIGAKKTMEIGVYTGYSLLATALAIPDDGTILAMDINRENYELGLPCIEKAGVAHKIDFREGPALPVLDALLEDEANHGTFDFVFVDADKDNYLNYHERLMKLVKLGGLLGYDNTLWNGSVVLPADAPMRKYIRYYRDFVLDLNKALAADQRVEICQLPVGDGITLCRRAK

SEQ ID NO: 6297 - protein, 258 aa, Unknown
  Sequence found in Organisms: Brassica napus, Brassica rapa
MATTTAEATKTSSTNVEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIS

SEQ ID NO: 6298 - protein, 258 aa, Brassica napus
MATTTADALKTSSTNVEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIS

SEQ ID NO: 6299 - protein, 248 aa, Ricinus communis
MASNNEEQQQNQAGRHQEVGHKSLLQSDALYQYILETSVYPNEPEPMKELRELTAKHPWNIMTTSADEGQFLNMLLKLINAKNTMEIGVYTGYSLLATALALPDDGKILAMDINRENYELGLPVIQKAGVAHKIEFREGPAMPVLDEMVADEKYHGSFDFIFVDADKDNYLNYHQRLVELVKVGGVIGYDNTLWNGSVVAPPDAPLRKYVRYYRDFVLELNKALPADPRIEICMLPVGDGITLCRRVK

SEQ ID NO: 6300 - protein, 254 aa, Mesembryanthemum crystallinum
MATTNVEENKQTQEQQPKEIKHQEVGHKSLLQSDALFQYILETSVYPREPEPMKELRDITAKHPWNLMTTSADEGQFLNMLLKLINAKNTIEIGVYTGYSLLASALALPDDGKILAMDINRENYELGLPVIQKAGVAHKIDFREGPALPVLDLLIEDAKNHGSFDFAFVDADKDNYGNYHKRLIDLVKIGGVIGYDNTLWNGSVAAPADAPMRKYVRYYRDFVMEFNKAIAADPRVEICQLPVGDGITLCRRIS

SEQ ID NO: 6301 - protein, 258 aa, Brassica juncea
MATTTAEAKKTSSTNVEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELNKALAADPRIEICMLPVGDGITICRRIS

SEQ ID NO: 6302 - protein, 252 aa, Artemisia annua
MATNGETKTESTNGEQVSRHQEVGHKSLLQSDALYQYILETSVYPREPEAMKELREVTAKHPWNIMTTSADEGQFLNMLLKLVNAKNTMEIGVFTGYSLLATALALPEDGKILAMDINRDNYEVGLPIIEKAGVAHKIEFKEGPALPVLDEMIAEGKYHGTYDFIFVDADKDNYINYHKRLIDLVKVGGLIGYDNTLWNGSVVAPPDAPLRKYVRYYRDFVLELNKALAADPRIEICMLPVGDGITLCRRVS

SEQ ID NO: 6303 - protein, 258 aa, Thellungiella halophila
MATTTTETTKTSTNGGEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAAPDAPMRKYVRYYRDFVLELNKALAADPRIEICMLPVGDGITICRRIN

SEQ ID NO: 6304 - protein, 281 aa, Jatropha curcas
MAPGHQQEQQNHQEGGHANLAQSLAIYKDILETKEPEPAEEQQNLVGRHQEIGHKSLLQSDALYQYILETSVYPREPEPLKELRELTANHPWNIMTTSADEGQFLSMLIKLINAKNTMEIGVYTGYSLLATALALPHDGKILAMDINRENYELGLPVIEKAGLAHKIDFREGPALPVLDQLVQDEKNHGSFDFIFVDADKDNYINYHKRTIELVKVGGIIGYDNTLWNGSVAAPPDAPLRKYVRFYRDYVLEFNKAMAADPRIEICQLPVGDGITLCRRIS

SEQ ID NO: 6305 - protein, 246 aa, Manihot esculenta
MASNNEQQNQAGRHQEVGHKSLLQSDALYQYILETSVYPTEPEPMKELRELTAKHPWNIMTTSADEGQFLSMLLKLMNAKNTMEIGVYTGYSLLATALALPDDGKILAMDINRENYELGLPVIQKAGVAHKIDFREGPALPVLDQMIAEGKYHGTFDFIFVDADKDNYLNYHKRLIELVKVGGLIGYDNTLWNGSVVAAPDAPLRKYVKYYRDFVMELNKALPADPRIEICMLPVGDGITLCRRIK

SEQ ID NO: 6306 - protein, 259 aa, Cryptomeria japonica
RCESMASTDVQKGTEVAKETTQQVSRHQEVGHKSLLQSDALYQYILETSVYPREPEPMRELREITAKHPWNLMTTSADEGQFLNLLLKLINAKNTMEIGVYTGYSLLSTALALPDDGKILAMDINRENYELGLPVIQKAGVAHKIDFREGPALPVLDQMLEDKEMHGSFDFIFVDADKDNYLNYHKRLIDLVKIGGVIGYDNTLWNGSVVAPPDAPLRKYVRYYRDFVIELNKALAADPRIEISQIPVGDGITLCRRVI

SEQ ID NO: 6307 - protein, 259 aa, Pinus taeda
MASTSVAAAEVKAQTTQAEEPVKVVRHQEVGHKSLLQSDALYQYILETSVYPREPEPMKELREVTAKHPWNLMTTSADEGQFLGLLLKLINAKNTMEIGVYTGYSLLSTALALPDDGKILAMDINRENYDIGLPIIEKAGVAHKIDFREGPALPVLDELLKNEDMHGSFDFVFVDADKDNYLNYHKRLIDLVKVGGLIAYDNTLWNGSVVAPPDAPLRKYVRYYRDFVMELNKALAVDPRIEISQIPVGDGVTLCRRVY

SEQ ID NO: 6308 - protein, 258 aa, Brassica oleracea
  misc_feature (231)..(231): Xaa can be any naturally occurring amino acid
MATTTAEATKTSSTNVEDKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDQLVADEKNHGTYDFIFVDADKDNYINYHKRLIDLVKVGGVIGYDNTLWNGSVVAPPDAPMRKYVRYYRDFVLELXKALAADPRIEICMLPVGDGITICRRIS

SEQ ID NO: 6309 - protein, 256 aa, Liriodendron tulipifera
MATNGVNAEQKTQEGEQKNQIFRHQEVGHKSLLQSDDLYQYILETSVYPREPESMKELREVTAKHPWNIMTTSADEGQFLNMLLKLINAKNTMEIGVFTGYSLLATALALPDDGKILAMDINRENYELGLPVIQKAGVAHKIEFREGPALPVLDQMLEDKKNHGSFDFIFVDADKDNYLNYHKRLIDLVKVGGVIGYDNTLWNGSVVAPPDAPLRKYVRYYRDFVLELNKALAADPRIEICQLPVGDGITLCRRFN

SEQ ID NO: 6310 - protein, 252 aa, Gerbera hybrid cultivar
MAINGETKTESNNGDQASRHQEVGHKSLLQSDALYQYILETSVYPREPEPMKELREVTAKHPWNIMTTSADEGQFLNMLLKLVNAKNTMEIGVFTGYSLLATALALPDDGQILAMDINKDNYELGRPIIEKAGVAHKIDFKEGPALPVLDQMIADGKYHGTFDFIFVDADKDNYINYHKRLIDLVKVGGLIGYDNTLWNGSVVAPPDAPMRKYVKYYRDFVLELNKALAADPRIEICMLPVGDGITLCRRIN

SEQ ID NO: 6311 - protein, 187 aa, Manihot esculenta
MTTSADEGQFLSMLLKLINAKNTMEIGVYTGYSLLATALALPDDGKILAMDINRENYELGLPVIEKAGVAHKIDFREGPALPVLDQLIQDEKCHGTFDFIFVDADKDNYLNYHKRTIELVKVGGLIGYDNTLWNGSVAAPPDAPLRKYVRFYLDYVLQFNKAIAADPRVEICQLPVGDGITLCRRIS

SEQ ID NO: 6312 - protein, 246 aa, Manihot esculenta
MASNNEQQNQAGRHQEVGHKSLLQSDALYQYILETSVYPTEPEPMKELRELTAKHPWNIMTTSADEGQFLSMLLKLMNAKNTMEIGVYTGYSLLATALALPDDGKILAMDINRENYELGLPVIQKAGVAHKVDFREGPALPVLDQMIAEGKYHGTFDFIFVDADKDNYLNYHKRLIELVKVGGLIGYDNTLWNGSVVAAPDAPLRKYVKYYRDFVMELNKALPADPRIEICMLPVGDGITLCRRIK

SEQ ID NO: 6313 - protein, 259 aa, Picea glauca
MASTAVQQTEMKAETTKAEEPAKVARHQEVGHKSLLQSDALYQYILETSVYPREPEPLKELREVTAKHPWNLMTTSADEGQFLGLLLKLINAKNTMEIGVYTGYSLLSTALALPDDGKILAMDINRENYDLGLPMIEKAGVAHKIDFREGPALPLLDQMIQNEELHGSFDFVFVDADKDNYLNYHKRLIDLVKVGGVIAYDNTLWNGSVVAPPDAPLRKYVRYYRDFVLELNKALAADPRIEISQIPVGDGVTLCRRVY

SEQ ID NO: 6314 - protein, 180 aa, Pinus taeda
MASTSVAAAEVKAQTTQAEEPVKVVRHQEVGHKSLLQSDALYQYILETSVYPREPEPMKELREVTAKHPWNLMTTSADEGQFLGLLLKLINAKNTMEIGVYSYSLLSTALALPDDGKILAMDINRENYDIGLPIIEKAGVAHKIDFREGPALPVLDELLKMRTCMDRSTLCSWMRTKTTI

SEQ ID NO: 6315 - protein, 258 aa, Panicum virgatum
MASTAAEAAKAAEQPANGNGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGTFDFAFVDADKDNYLNYHERLLKLVKLGGLIGYDNTLWNGSVVLPDDAPMRKYIRYYRDFVLVLNKALAADERVEICQLPVGDGVTLCRRVK

SEQ ID NO: 6316 - protein, 257 aa, Panicum virgatum
MASTAAEQPAQEQQANGNGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGTFDFVFVDADKDNYLNYHERLLKLVKLGGLIGYDNTLWNGSVVLPDDAPMRKYIRYYRDFVLVLNKALAADERVEICQLPVGDGVTLCRRVK

SEQ ID NO: 6317 - protein, 259 aa, Taraxacum officinale
  misc_feature (64)..(64): Xaa can be any naturally occurring amino acid
  misc_feature (245)..(245): Xaa can be any naturally occurring amino acid
  misc_feature (253)..(253): Xaa can be any naturally occurring amino acid
MATIGEAQPAKHQEVGHKSLLQSDALYQYILETSVYPREPESMKELREVTAKHPWNLMTTSADXGQFLNLLLKLINAKNTMEIGVYTGYSLLSTALALPEDGKILALDINRENYEIGLPIIEKAGVAHKIDFREGPALPLLDEMVDDVKLHGSFDFIFVDADKDNYLNYHKRLIDLIKIGGVIGYDNTLWNGSLVAPPDAPLRKYVRYYRDFVLELNKALAVDPRVEICQLPVGDGITLCRRISXNTNYGPTXHAYTYS

SEQ ID NO: 6318 - protein, 259 aa, Unknown
  Sequence found in Organisms: Arabidopsis thaliana, Arabidopsis lyrata
MATTTTEATKTSSTNGEDQKQSQNLRHQEVGHKSLLQSDDLYQYILETSVYPREPESMKELREVTAKHPWNIMTTSADEGQFLNMLIKLVNAKNTMEIGVYTGYSLLATALALPEDGKILAMDVNRENYELGLPIIEKAGVAHKIDFREGPALPVLDEIVADEKNHGTYDFIFVDADKDNYINYHKRLIDLVKIGGVIGYDNTLWNGSVVAPPDAPMRKYVRYYRDFVLELNKALAADPRIEICMLPVGDGITICRRIS

SEQ ID NO: 6319 - protein, 119 aa, Pinus taeda
MASTAVQQTEVKAETTQAEEPTKVARHQEVGHKSLLQSDALYQYILETSVYPREPAPLKELREVTAKHPWNLMTTSADEGQFLGLLLKLINAKNTMEIGVYTVTRFSAQPLHCPMMERF

SEQ ID NO: 6320 - protein, 259 aa, Pinus taeda
MAGTSVAAAEVKAQTTQAEEPVKVVRHQEVGHKSLLQSDALYQYILETSVYPREPEPMKELREVTAKHPWNLMTTSADEGQFLGLLLKLINAKNTMEIGVYTGYSLLSTALALPDDGKILAMDINRENYDIGLPIIEKAGVAHKIDFREGPAMPVLDELVKNEDMHGSFDFVFVDADKDNYLNYHKRLIDLVKVGGLIAYDNTLWNGSVVAPPDAPLRKYVRYYRDFVMELNKALAVDPRIEISQIPVGDGVTLCRRVY

SEQ ID NO: 6321 - protein, 259 aa, Pinus taeda
MASTDVAAAEVKAQTTQAEEPAKVVRHQEVGHKSLLQSDALYQYILETSVYPREPEPMKELREVTAKHPWNLMTTSADEGQFLGLLLKLINAKNTMEIGVYTGYSLLSTALALPDDGKILAMDINRENYDIGLPIIEKAGVAHKIDFREGPALPVLDEMVKNEDMHGSFDFVFVDADKDNYLNYHKRLIDLVKVGGLIAYDNTLWNGSVVAPPDAPLRKYVRYYRDFVMELNKALAVDPRIEISQIPVGDGVTLCRRVY

SEQ ID NO: 6322 - protein, 225 aa, Artemisia annua
LLQSDALYQYILETSVYPREPQPMKELREVTAKHPWNLMTTSADEGQFLNLLLKLINAKNTMEIGVYTGYSLLSTALALPEDGKILALDINRENYEIGLPIIEKAGVAHKIDFREGPALPLLDQMVDDVTFHGSFDFIFVDADKDNYLNYHKRLIDLVKIGGVIGYDNTLWNGSLVAPPDAPLRKYVRYYRDFVLELNKALAADPRVEICQLPVGDGITLCRRIN

SEQ ID NO: 6323 - protein, 279 aa, Manihot esculenta
  misc_feature (157)..(157): Xaa can be any naturally occurring amino acid
MAPGQEEQQNQQGGHQNLQQSLAIYKDILETKEPEPKQEQQNLVGRHQEIGHKSLLQSDALYQYILETSVYPREPAPLTELRELTANHPWNIMTTSADEGQFLSMLLKLINAKNTMEIGVYTGYSLLATALALPDDGKILAMDINRENYELGLPVIXKAGVAHKIDFREGPALPVLDQLIQDEKCHGTFDFIFVDADKDNYLNYHKRTIELVKVGGLIGYDNTLWNGSVAAPPDAPLRKYVRFYLDYVLQFNKAIAADPRVEICQLPVGDGITLCRRIS

SEQ ID NO: 6324 - protein, 266 aa, Festuca arundinacea
  misc_feature (69)..(69): Xaa can be any naturally occurring amino acid
MATTAADATATVAKEQQTTTNGAASAGEQVTRHSEVGHKSLLQSDALYQYILETTVYPREHECMKQLRXDTANHPWNLMTTSADEGQFLNLLIKLIGAKKTMEIGVYTGYSLLATALAIPEDGTILAMDINRENYETIGKPCIEKAGVAHKIDFREGPALPVLDELLQDEANHGTFDFVFVDADKDNYLNYHERLMKLVRVGGLLGYDNTLWNGSVVLPADAPMRKYIRYYRDFVLELNKALAADDRVEICQLPVGDGITLCRRAK

SEQ ID NO: 6325 - protein, 309 aa, Ricinus communis
MAPGLEEKQNQEGGHTNITQSLAIYKASIYYIFSNIPFLALSNYIGCFSFSLTSCTSFISCRIYLKLRSLNQHKSKKTKLVDIKKLDTRVFYRYILQTSVYPGEPEPMKELRELTATHKWNIMTTSADEGQFLSMLLKLINAKNTMEIGVYTGYSLLATALALPEDGKILAMDINRENYELGLPVIKKAGVAHKIDFREGPALPVLDQLIQDGKHHGTFDFIFVDADKDNYLNYHKRTIELVKVGGVIGYDNTLWNGSVAAPPDAPMRKYVRFYRDYVMEFNKAIAADPRVEICQLPIGDGITLCRRIS

SEQ ID NO: 6326 - protein, 189 aa, Sorghum bicolor
MGRWWQAALLGCAVAVAVLAAAVECAVTYDKKAVLIDGQRRILFSGSIHYPRSTPDMWEGLIQKAKDGGLDVIQTYVFWNGHEPTPGNYYFEERYDLVRFIKTVQKAGLFVHLRIGPYICGEWNFGGFPVWLKYVPGISFRTDNEPFKTAMQGFTEKIVGMMKSEKLFASQGGPIILSQASIIVFLRFD

SEQ ID NO: 6327 - protein, 716 aa, Arabidopsis lyrata
MEAARVFGLCLILVGMFLVFPGGATAAKGVTYDGRSLIIDGQRKLLFSGSIHYPRSTPEMWPSLIKKTKEGGIDVIQTYVFWNLHEPKLGQYDFSGRNDLVKFIKEIRSQGLYVCLRIGPFIEAEWNYGGLPFWLRDVPGMVYRTDNEPFKFHMQKFTTKIVNLMKSEGLYASQGGPIILSQIENEYANVEAAFHEKGASYIKWAGQMAVGLKTGVPWIMCKSPDAPDPVINTCNGMRCGETFPGPNSPNKPKMWTEDWTSFFQVYGTEPYIRSAEDIAFHAVLFIAKNGSYINYYMYHGGTNFGRTSSSYFITGYYDQAPLDEYGLLRQPKYGHLKELHAAIKSSANPLLQGKQTILSLGPMQQAYVFEDASSGCVAFLVNNDAKVSQIQFRKSSYSLSPKSIGILQNCKNLIYETAKVNVEKNKRVTTPVQVFNVPEKWEGFRETIPAFSGTSLKANALLEHTNLTKDKTDYLWYTSSFKPDSPCTNPSIYIESSGHVVHVFVNNALAGSGHGSRDIKVVKLQVPASLTNGQNSISILSGMVGLPDSGAYMERKSYGLTKVQISCGGTKPIDLSGSQWGYSVGLLGEKVRLQQWRNLNRVKWSMNNAGLIKNRPLIWYKTIFDGPNGDGPVGLNMSSMGKGEIWVNGESIGRYWVSFLTPSGHPSQSIYHIPREFLKPSGNLLVVFEEEGGDPLGISLNTISVIGSNRAQSQLS

SEQ ID NO: 6328 - protein, 356 aa, Brassica napus
MEASGVVLRQIPCVSGSVTDGRYSGLRFSGSMRTTVGFQTRRFRGIVCSNEFADKGHMSYYSGTTRCGGEGKDKVKVMEKEKKKEMKKKAKVLKALSKNLNMFSSIGFGLDPEAGLVAEIQNKTISEATEILVKQLDQLKAEEKLLKKQRKEEKAKAKAMKMMTEMDSESSSSSESSDSDCGKGKVVDMSSLRNKAKPILEPLQPESGVATLPRIQQDSCKNTTGEALKLALLESAAATTAFPSVVNPGLPLKTVEAVPVVGLPSKRVEVCMGGKCKKSGGAVLLDEFQKAMTGMEGSAVGCKCMGKCRDGPNVRVVNETDAVMTDSVRTPSKTVCVGVGLQDVETIVTSFFGEEF

SEQ ID NO: 6329 - protein, 344 aa, Brassica rapa
  misc_feature (53)..(54): Xaa can be any naturally occurring amino acid
CVSGSVTDGRYSGLRFSGSMRTTVGFQTRRFRGIVCSNEFADKGHMSYYSGTXXCGGEGKDKVKVMEKEKKKEMKKKAKVLKALSKNLNMFSSIGFGLDPEAGLVAEIQNKTISEATEILVKQLDQLKAEEKLLKKQRKEEKAKAKAMKMMTEMDSESSSSSESSDSDCGKGKVVDMSSLRNKAKPILEPLQPESGVATLPRIQQDSCKNTTGEALKLALLESAAATTAFPSVVNPGLPLKTVEAVPVVGLPSKRVEVCMGGKCKKSGGAVLLDEFQKAMTGMEGSAVGCKCMGKCRDGPNVRVVNETDAVMTDSVRTPSKTVCVGVGLQDVETIVTSFFGEEF

SEQ ID NO: 6330 - protein, 193 aa, Unknown
  Sequence found in Organisms: Brassica napus, Brassica rapa, Raphanus sativus
MFMIDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLATVPFLILGNKIDIPYAASEDELRYHLGLSNFTTGKGKVNLVDSNVRPLEVFMCSIVRKMGYGEGFKWLSQYIK

SEQ ID NO: 6331 - protein, 193 aa, Brassica napus
MFVIDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLATVPFLILGNKIDIPYAASEDELRYHLGLSNFTTGKGKVNLVDSNLRPLEVFMCSIVRKMGYGEGFKWLSQYIK

SEQ ID NO: 6332 - protein, 193 aa, Arabidopsis lyrata
MFLVDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLATVPFLILGNKIDIPYAASEDELRFHLGLSNFTTGKGKVNLTDSNVRPLEVFMCSIVRKMGYGEGFKWLSQYIK

SEQ ID NO: 6333 - protein, 193 aa, Arabidopsis lyrata
MFLVDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLANVPFLILGNKIDIPYAASEDELRYHLGLSNFTTGKGKVNLTDSNVRPLEVFMCSIVRKMGYGEGFKWLSQYIK

SEQ ID NO: 6334 - protein, 193 aa, Arabidopsis thaliana
MFMIDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLASVPFLILGNKIDIPYAASEDELRYHLGLSNFTTGKGKVNLTDSNVRPLEVFMCSIVRKMGYGEGFKWVSQYIK

SEQ ID NO: 6335 - protein, 193 aa, Malus domestica
MFLVDWFYGVLASLGLWQKEAKILFLGLDNAGKTTLLHMLKDERLVQHQPTQHPTSEELSIGKIKFKAFDLGGHQVARRVWKDYYAKVDSVVYLVDAYDKERFAESKKELDALLSDESLATVPFLILGNKIDIPYAASEDELRYHLGLTNFTTGKGKVNLTDSNVRPLEVFMCSIVRKMGYGEGFKWLSQYIK

SEQ ID NO: 6336 - protein, 193 aa, Citrus sinensis
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKRELDALLSDESLANVPFLILGNKIDIPYAASEDELRYHLGLTNFTTGKGKVNLVDSNVRPLEVFMCSIVRKMGYGEGFKWLSQYIK

SEQ ID NO: 6337 - protein, 193 aa, Fragaria vesca
MFLFDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLASVPFLILGNKIDIPYAASEDELRYHLGLTNFTTGKGKVNLADSNVRPLEVFMCSIVRKMGYGDGFKWLSQYIK

SEQ ID NO: 6338 - protein, 193 aa, Manihot esculenta
MFLLDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDEALANVPFLILGNKIDIPYAASEDELRYHLGLTNFTTGKGKVNLTDSNVRPLEVFMCSIVRKMGYGDGFKWLSQYIK

SEQ ID NO: 6339 - protein, 193 aa, Cleome spinosa
MFLVDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDEDLANVPFLILGNKIDIPYAASEDEMRYHLGLSNFTTGKGKVNLADSNVRPLEVFMCSIVRKMGYGDGFKWLSQYIK

SEQ ID NO: 6340 - protein, 193 aa, Cucumis sativus
MFLIDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLATVPFLILGNKIDIPYAASEDELRYHLGLTNFTTGKGKVNLTDSNVRPLEVFMCSIVRKMGYGDGFKWMSQYIK

SEQ ID NO: 6341 - protein, 193 aa, Cucumis melo
MFLIDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLATVPFLILGNKIDIPYAASEDELRYHLGLTNFTTGKGKVNLADSNVRPLEVFMCSIVRKMGYGDGFKWMSQYIK

SEQ ID NO: 6342 - protein, 193 aa, Tropaeolum majus
MFLFDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIPYAASEDELRYHLGLTNFTTGKGKVNLSDSNVRPLEVFMCSIVRKMGYGDGFKWVSQYIK

SEQ ID NO: 6343 - protein, 193 aa, Malus domestica
MFLVDWFYGVLASLGLWQKEAKILFLGLDNAGKTTLLHMLKDERLVQHQPTQHPTSEELSIGMIKFKAFDLGGHQVARRVWKDYYAKVDAVVYLVDAYDKERFAESKKELDALLSDESLATAPFLILGNKIDIPYAASEDELRYHLGLTNFTTGKGKVNLADSNVRPLEVFMCSIVRKMGYGEGFKWLSQYIK

SEQ ID NO: 6344 - protein, 193 aa, Manihot esculenta
MFLFDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLANVPFLILGNKIDIPYAASEDELRYHLGLTNFTTGKGKVNLTDSNVRPLEVFMCSIVRKMGYGDGFKWVSQYIK

SEQ ID NO: 6345 - protein, 193 aa, Ricinus communis
MFLLDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDEALANVPFLILGNKIDIPYAASEDELRYHLGLSTFTTGKGKVNLTDSNVRPLEVFMCSIVRKMGYGDGFKWLSQYIK

SEQ ID NO: 6346 - protein, 193 aa, Vitis vinifera
MFLFDWFYGLLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKRELDALLSDESLANVPFLILGNKIDIPYAASEDELRYHLGLTNFTTGKGKVNLVDSNVRPLEVFMCSIVRKMGYGEGFKWVSQYIK

SEQ ID NO: 6347 - protein, 193 aa, Medicago truncatula
MFIFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLANVPFLILGNKIDIPYAASEDELRYHLGLTNFTTGKGKVNLTDSNVRPLEVFMCSIVRKMGYGEGFQWLSQYIK

SEQ ID NO: 6348 - protein, 193 aa, Cucumis sativus
MFLVDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFTESKKELDALLSDESLADVPFLILGNKIDIPYAASEDELRYNLGLTNFTTGKGKVNLGDSNVRPLEVFMCSIVRKMGYGDGFKWLSQYIK

SEQ ID NO: 6349 - protein, 193 aa, Pennisetum glaucum
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIPYAASEEELRYYLGLSNFTTGKGNVNLVDSNVRPLEVFMCSVVRKMGYGEGFKWMSQYIK

SEQ ID NO: 6350 - protein, 193 aa, Malus domestica
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIPYAASEEELRFHLGLNNFTTGKGKVNLQDSNVRPLEVFMCSIVRKMGYGDGFKWLSQYIK

SEQ ID NO: 6351 - protein, 193 aa, Populus trichocarpa
MFLLDWFYGVLASLGLWQKEAKILFLGLDNAGKTTLLHMLKDERLVQHQPTQHPTSEELSIGKIKFKAFDLGGHQIARRVWKDYYAKVDAVVYLVDAFDKERFAESKKELDALLSDESLANVPFLILGNKIDIPYAASEDELRYSLGLNNFTTGKGKVNLVDSNVRPLEVFMCSIVRKMGYGDGFKWMSQYIK

SEQ ID NO: 6352 - protein, 193 aa, Populus trichocarpa
MFLLDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKVRFAESKKELDALLSDESLANVPFLILGNKIDIPYAASEDELRYDLGLNNFTTGKGKVNLVDSNVRPLEVFMCSIVRKMGYGDGFKWMSQYIK

SEQ ID NO: 6353 - protein, 210 aa, Jatropha curcas
MFLLDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDEALANVPFLILGNKIDIPYAASEDELRYHLGLTNFTTGKGKVNLTDSKCSPPRSFHVQYCPQDGLWRWLPVALAIHQIECGKTSGLVFFWSLSC

SEQ ID NO: 6354 - protein, 193 aa, Unknown
  Sequence found in Organisms: Zea mays, Pennisetum glaucum, Sorghum bicolor, Brachypodium distachyon, Cenchrus ciliaris, Saccharum officinarum, Panicum virgatum
MFLWDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDDSLANVPFLILGNKIDIPYAASEEELRYHLGLSNFTTGKGKVNLGDSNVRPLEVFMCSVVRKMGYGDGFKWVSQYIK

SEQ ID NO: 6355 - protein, 193 aa, Cleome gynandra
MFVFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFVESKRELDALLSDESLANVPFLILGNKIDIPYAASEDELRYHLGLTNFTTGKGKVNLADSGVRPLEVFMCSIVRKMGYGEGFKWVSQYIK

SEQ ID NO: 6356 - protein, 193 aa, Heritiera littoralis
MFLLDWFYGVLASLGLWQKEAKILFLGLDNAGKTTLLHMLKDERLAQHQPTQYPTSEELSIGKIKFKAFDLGGHQIARRVWKDYYAKVDAVVYLVDAYDKERFAESKKELDALLSDEALANVPFLILGNKIDIPYAASEDELRYHLGLTNFTTGKGKVNLADSNVRPLEVFMCSIVRKMGYGEGFKWMSQYIK

SEQ ID NO: 6357 - protein, 193 aa, Heritiera littoralis
MFFFDWFYGILASLGLWQKEAKILFLGLDNAGKTTLLHMLKDERLAQHQPTQHPTSEELSIGKIKFKAFDLGGHQIARRVWKDYYAKVDAVVYLVDAYDKERFAESKKELDALLSDESLVNVPFLILGNKIDIPYAASEDELRYHLGLTNFTTGKGKVNLGDSNVRPLEVFMCSIVRKMGYGDGFKWLSQYIK

SEQ ID NO: 6358 - protein, 193 aa, Cucumis melo
MFLVDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFTESKKELDALLSDEALADVPFLILGNKIDIPYAASEDELRYNLGLTNFTTGKGKVNLGDSNVRPLEVFMCSIVRKMGYGDGFKWLSQYIK

SEQ ID NO: 6359 - protein, 193 aa, Cucumis melo
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLANVPFLVLGNKIDIPYAASEDELRYHLGLTNFTTGKGKVNLADTNVRPLEVFMCSIVRKMGYGDGFKWLSQYIK

SEQ ID NO: 6360 - protein, 193 aa, Quercus alba
MFLFDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALANVPFLILGNKIDIPYAASEDELRFHLGLTNFTTGKGKVNLADSNVRPLEVFMCSIVRKMGYGDGFKWLSQYIK

SEQ ID NO: 6361 - protein, 193 aa, Malus domestica
MFLFDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKDRFAESKKELDALLSDESLATVPFLVLGNKIDIPYAASEDELRYHLGLTNFTTGKGKVNLTDSTVRPLEVFMCSIVRKMGYGDGFKWVSQYIK

SEQ ID NO: 6362 - protein, 193 aa, Malus domestica
MFLFDWFYGVLASLGLWQKEAKILFLGLDNAGKTTLLHMLKDERLVQHQPTQYPTSEELSIGKIKFKAFDLGGHQIARRVWRDYYAKVDAVVYLVDAYDKERFAESKKELDALLSDEALATVPFLILGNKIDLPYAASEDELRYHLGLTNFTTGKGKVNLTDSNVRPLEVFMCSIVRKMGYGDGFKWLSQYIK

SEQ ID NO: 6363 - protein, 193 aa, Hordeum vulgare
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDDSLATVPFLILGNKIDIPYAASEEELRYHLGLSNFTTGKGKVSLSESNVRPLEVFMCSIVRKMGYGEGFKWMSQYIK

SEQ ID NO: 6364 - protein, 193 aa, Theobroma cacao
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALANVPFLILGNKIDIPYAASEDELRYHLGLTNFTTGKGKVNLADSNVRPLEVFMCSIVRKMGYGDGFKWMSQYIK

SEQ ID NO: 6365 - protein, 193 aa, Ricinus communis
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALANVPFLILGNKIDIPYAASEDELRYHLGLTNFTTGKGKVNLTDTNVRPLEVFMCSIVRKMGYGDGFKWLSQYIK

SEQ ID NO: 6366 - protein, 193 aa, Castanea mollissima
MFLFDWFYGILASLGLWQKEAKILFLGLDNAGKTTLLHMLKDERLVQHQPTQYPTSEELSIGQIKFKAFDLGGHSIARRVWKDYYAKVDAVVYLVDAYDKERFAESKKELDALLSDESLATVPFLILGNKIDIPYAASEDELRYHMGLTNFTTGKGKVNLADSNVRPLEVFMCSIVRKMGYGEGFKWLSQYIK

SEQ ID NO: 6367 - protein, 193 aa, Citrus sinensis
MFLLDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKRELDALLSDEALANVPFLILGNKIDIPYAASEDELRYHLGLTNFTTGKGKVNLMDSSVRPLEVFMCSIVRKMGYGDGFKWLSQYIK

SEQ ID NO: 6368 - protein, 193 aa, Citrus sinensis
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALANVPFLVLGNKIDIPYAASEEELRYHLGLSNFTTGKGKVNLADSNVRPLEVFMCSIVRKMGYGDGFKWLSQYIK

SEQ ID NO: 6369 - protein, 193 aa, Gossypium hirsutum
MFLFDWFYGILASLGLWHKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLANVPFLILGNKIDIPYAASEDELRYHLGLTNFTTGKGKVNLGDSNVRPLEVFMCSIVRKMGYGDGFKWVSQYIK

SEQ ID NO: 6370 - protein, 193 aa, Gossypium hirsutum
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALANVPFLILGNKIDIPYAASEDELRYHLGLTNFTTGKGKVNLADSNVRPLEVFMCSIVRKMGYGDGFKWMSQYIK

SEQ ID NO: 6371 - protein, 193 aa, Eucalyptus gunnii
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALANVPFLVLGNKIDIPYAASEDELRYHLGLTNFTTGKGKVNLVDSNVRPLEVFMCSIVRKMGYGDGFKWVSQYIK

SEQ ID NO: 6372 - protein, 193 aa, Vitis vinifera
MFILDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALANVPFLVLGNKIDIPYAASEDELRYHLGLTNFTTGKGKVNLADSNVRPLEVFMCSIVRKMGYGDGFKWLSQYIK

SEQ ID NO: 6373 - protein, 193 aa, Lolium multiflorum
MFLWDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDDSLANVPFLILGNKIDIPYAASEEELRYHIGLSNFTTGKGKVNLVDSNVRPLEVFMCSVVRKMGYGDGFKWVSQYIK

SEQ ID NO: 6374 - protein, 193 aa, Allium cepa
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLAAVPFLILGNKIDIPYAASEEELRYHLGLSNFTTGKGKVNLSDSNVRPLEVFMCSIVRKMGYGDGFKWVSQYIK

SEQ ID NO: 6375 - protein, 193 aa, Fragaria vesca
MFLVDWFYGVLASLGLWQKEAKILFLGLDNAGKTTLLHMLKDERLVQHQPTQYPTSEELSIGQIKFKAFDLGGHQIARRVWKDYYAKVDAVVYLVDAFDKERFAESKKELDALLSDESLATVPFLILGNKIDIPYAASEDELRYHMGLTNFTTGKGKVNLADSNVRPLEVFMCSIVRKMGYGEGFKWVSQYIK

SEQ ID NO: 6376 - protein, 193 aa, Triticum aestivum
MFLWDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFTESKKELDALLSDDSLANVPFLILGNKIDIPYAASEEELRYHLGLSNFTTGKGKVNLVDSNVRPLEVFMCSVVRKMGYGDGFKWVSQYIK

SEQ ID NO: 6377 - protein, 248 aa, Quercus alba
MFLFDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALANVPFLILGNKIDIPYAASEDELRFHLGLTNFTTGKGKVNLADSNVRPLEVFMCSIVRKMGYGDGFKWLSQYIVMVSKIPPLNLEIPPNHTPRYPKNVSIPVCFSPKLALNWMYYVWICVEGGFNVNVL

SEQ ID NO: 6378 - protein, 140 aa, Vitis vinifera
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALAQCSIPCSGQQDRYPIRCLRR

SEQ ID NO: 6379 - protein, 193 aa, Arabidopsis lyrata
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKRELDALLSDEALATVPFLILGNKIDIPYAASEDELRYHLGLTNFTTGKGKVALGDSGVRPLEVFMCSIVRKMGYGEGFKWLSQYIN

SEQ ID NO: 6380 - protein, 193 aa, Arabidopsis lyrata
MFLVDWFYGVLATLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLATVPFLVLGNKIDIPYAASEDELRYHLGLTNFTTGKGKVNLAGTNVRPLEVFMCSIVRKMGYGEGFKWVSQYID

SEQ ID NO: 6381 - protein, 193 aa, Gossypium hirsutum
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALANVPFLILGNKIDIPYAASEDELRYHLGLTNFTTGEGKVNLADSNVRPLEVFMCSIVRKMGYGDGFKWMSQYIK

SEQ ID NO: 6382 - protein, 193 aa, Cucumis sativus
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLANVPFLVLGNKIDIPYAASEDELRYHLGLTNFTTGKGKVNLADTNVRPLEVFMCSIVRKMGYGDGFKWVSQYIK

SEQ ID NO: 6383 - protein, 193 aa, Unknown
  Sequence found in Organisms: Solanum melongena, Capsicum annuum, Solanum tuberosum, Solanum phureja
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIPYAASEDELRYHLGLTGVTTGKGKVNLADSSVRPLEVFMCSIVRKMGYGDGFKWVSQYIK

SEQ ID NO: 6384 - protein, 193 aa, Avena sativa
MFLWDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDDSLANVPFLILGNKIDIPYAASEEELRYHLGLSNFTTGKGKVSLGDSNVRPLEVFMCSVVRKMGYGDGFKWVSQYIK

SEQ ID NO: 6385 - protein, 193 aa, Prunus persica
MFLFDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEGLANVPFLILGNKIDIPYAASEEELRFHLGLNNFTTGKGKVNLTDSNVRPLEVFMCSIVRKMGYGDGFKWLSQYIK

SEQ ID NO: 6386 - protein, 193 aa, Arabidopsis thaliana
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKRELDALLSDEALATVPFLILGNKIDIPYAASEDELRYHLGLTNFTTGKGKVTLGDSGVRPLEVFMCSIVRKMGYGEGFKWLSQYIN

SEQ ID NO: 6387 - protein, 193 aa, Hordeum vulgare
MFLWDWFYGVLASLGLWQKEAKILFLGLDNAGKTTLLHMLKDERLVQHQPTQHPTSEELSIGKIKFKAFDLGGHQIARRVWKDYYARVDAVVYLVDAYDKERFTESKKELDALLSDDSLANVPFLILGNKIDIPYAASEEELRYHLGLSNFTTGKGKVNLVDSNVRPLEVFMCSVVRKMGYGDGFKWVSQYIK

SEQ ID NO: 6388 - protein, 193 aa, Gossypium hirsutum
MFIFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKRELDALLSDEALANVPFLILGNKIDIPYAASEDELRYHLGLTNFTTGKGKVNLGDSNVRPLEVFMCSIVRKMGYGDGFKWVSQYIK

SEQ ID NO: 6389 - protein, 193 aa, Gossypium hirsutum
MFLVDWFYGILASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLANVPFLILGNKIDIPYAASEDELRYHLGLTNFTTGKGKVNLADSNVRPLEVFMCSIVRKMGYGDGFKWMSQYIN

SEQ ID NO: 6390 - protein, 193 aa, Unknown
  Sequence found in Organisms: Glycine max, Vigna unguiculata
MFLFDWFYGILASLGLWQKEAKILFLGLDNAGKTTLLHMLKDERLVQHQPTQYPTSEELSIGKIKFKAFDLGGHQIARRVWKDYYAKVDAVVYLVDAYDKERFSESKKELDALLSDESLANVPFLILGNKIDIPYAASEDELRYHMGLSNFTTGKGKVNLADSNLRPLEVFMCSIVRKMGYGEGFQWLSQYIK

SEQ ID NO: 6391 - protein, 193 aa, Zingiber officinale
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERLAESKKELDALLSDEALANVPFLILGNKIDIPYAASEDELRYHLGLNNFTTGKGKVNLADSNVRPLEIFMCSIVRKMGYGEGFKWVSQYIK

SEQ ID NO: 6392 - protein, 193 aa, Papaver somniferum
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLATVPFLVLGNKIDIPYAASEDELRYHLGLTNFTTGKGNVNLSDSNVRPLEVFMCSIVRKMGYGDGFKWVSQYIK

SEQ ID NO: 6393 - protein, 193 aa, Papaver somniferum
  misc_feature (3)..(3): Xaa can be any naturally occurring amino acid
  misc_feature (38)..(38): Xaa can be any naturally occurring amino acid
  misc_feature (75)..(75): Xaa can be any naturally occurring amino acid
MFXVDWFYGVLASLGLWQKEAKILFLGLDNAGKTTLLXMLKDERLVQHQPTQYPTSEELSIGKIKFKAFDLGGHXIARRVWKDYYAKVDAVVYLVDAYDKERFAESKKELDALLSDESLATVPFLVLGNKIDIPYAASEDELRYHLGLTNFTTGKGNVNLADSNVRPLEVFMCSIVRKMGYGEGFKWVSQYIK

SEQ ID NO: 6394 - protein, 193 aa, Prunus persica
MFLVDWFYGVLASLGLWQKEAKILFLGLDNAGKTTLLHMLKDERLVQHQPTQYPTSEELSIGQIKFKAFDLGGHQIARRVWKDYYAKVDAVVYLVDAYDKERFAESKKELDALLSDESLANVPFLILGNKIDIPYAASEDELRHHMGLTNFTTGKGKVNLADSNVRPLEVFMCSIVRKMGYGEGFKWLSQYIN

SEQ ID NO: 6395 - protein, 193 aa, Pseudoroegneria spicata
MFLWDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFTESKKELDALLSDDSLANVPFLILGNKIDIPYAASEEELRYHLGLSNFTTGKGKVNLGDSNVRPLEVFMCSVVRKMGYGDGFKWVSQYIK

SEQ ID NO: 6396 - protein, 193 aa, Rosa hybrid cultivar
MFLFDWFYGVLASLGLWQKEAKILFLGLDNAGKTTLLHMLKDERLVQHQPTQYPTSEELSIGKIKFKAFDLGGHQIARRVWKDYYAKVDAVVYLVDSYDKERFAESKKELDALLSDEALATVPFLILGNKIDIPYAASEEELRYHLGLNNFTTGKGKVNLADSNVRPLEVFMCSIVRKMGYGDGFKWVSQYIK

SEQ ID NO: 6397 - protein, 193 aa, Fragaria vesca
MFLWDWFYGVLASLGLWQKEAKILFLGLDNAGKTTLLHMLKDERLVQHQPTQYPTSEELSIGKIKFKAFDLGGHQIARRVWKDYYAKVDAVVYLVDSYDKERFAESKKELDALLSDEALATVPFLILGNKIDIPYAASEEELRYHLGLNNFTTGKGKVNLTDSNVRPLEVFMCSIVRKMGYGDGFKWVSQYIK

SEQ ID NO: 6398 - protein, 193 aa, Panicum virgatum
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDDSLATVPFLILGNKIDIPYAASEEELRYHMGLSNFTTGKGNVNLGESNVRPLEVFMCSIVRKMGYGEGFKWVSQYIK

SEQ ID NO: 6399 - protein, 193 aa, Solanum lycopersicum
MFLFDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIPYAASEDELRYHLGLTGVTTGKGKVNLADSSVRPLEVFMCSIVRKMGYGDGFKWVSQYIK

SEQ ID NO: 6400 - protein, 193 aa, Triphysaria pusilla
MFLLDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLATVPFLILGNKIDIPYAASEDELRYHLGLMGITTGKGVVNLTDSNVRPTEVFMCSIVRKMGYGDGFKWVSQYIK

SEQ ID NO: 6401 - protein, 193 aa, Triticum aestivum
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDDSLATVPFLILGNKIDIPYAASEEELRYHMGLSNFTTGKGKVSLSESNVRPLEVFMCSIVRKMGYGEGFKWMSQYIK

SEQ ID NO: 6402 - protein, 193 aa, Ipomoea nil
MFLVDWFYGILASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLANVPFLILGNKIDIPYAASEDELRYHMGLTGITTGKGKVNLADSNVRPLEVFMCSIVRKMGYGEGFKWMSQYIK

SEQ ID NO: 6403 - protein, 193 aa, Avena sativa
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDDSLGTVPFLILGNKIDIPYAASEEELRYHMGLSNFTTGKGKVNLSESNVRPLEVFMCSIVRKMGYGDGFKWMSQYIK

SEQ ID NO: 6404 - protein, 193 aa, Orobanche aegyptiaca
MFLLDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLATVPFLILGNKIDIPHAASEDELRYNLGLDRLTTGKGKVNLNDSNVRPIEVFMCSIVRKMGYGDGFKWVSQYIK

SEQ ID NO: 6405 - protein, 193 aa, Rhizophora mangle
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERLAESKKELDALLSDEALSNVPFLVLGNKIDIPYAASEDELRYHLGLSNFTTGKGMVNLTDSNVRPLEVFMCSIVRKMGYGDGFKWLSQYIK

SEQ ID NO: 6406 - protein, 193 aa, Malus domestica
MFLFDWFYGVLASLGLWQKEAKILFLGLDNAGKTTLLHMLKDERLVQHQPTQYPTSEELSIGKIKFKAFDLGGHQIARRVWRDYYAKVDAVVYLVDAYDKERFAESKKELDALLSDEALATVPFLILGNKIDLPSAASEDELRYHLGLTNFTTGKGKVNLADSTVRPLEVFMCSIVRKMGYGDGFKWLSQYIK

SEQ ID NO: 6407 - protein, 193 aa, Malus domestica
MFLLDWFYGVLASLGLWQKEAKILFLGLDNAGKTTLLHMLKDERLVQHQPTQHPTSEELSIGKIKFKAFDLGGHSIARRVWKDYYAKVDAVVYLVDAYDKDRFAESKKELDALLSDESLATVPFLVLGNKIDIPYAASEDELRYYLGLTNFTTGKGKVNLTDSTVRPLEVFMCSIVRKMGYGDGFKWVSQYIK

SEQ ID NO: 6408 - protein, 193 aa, Arabidopsis thaliana
MFLVDWFYGVLATLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLANVPFLILGNKIDIPYAASEDELRYHLGLTSFTTGKGKVNLAGTNVRPLEVFMCSIVRKMGYGEGFKWVSQYID

SEQ ID NO: 6409 - protein, 193 aa, Musa acuminata
MFLIDWFYGILASLGLWQKEAKILFLGLDNAGKTTLLHMLKDERLVQHQPTQYPTSEELSIGKIKFKAFDLGGHQIARRVWKDYYAKVDAVVYLVDAADKERFAESKKELDALLSDDALANVPFLILGNKIDIPYAASEDELRYHLGLSNFTTGKGKVNLADTNVRPLEVFMCSIVRKMGYGEGFRWMSQYIK

SEQ ID NO: 6410 - protein, 193 aa, Musa acuminata
MFIIDWFYGILASLGLWQKEAKILFLGLDNAGKTTLLHMLKDERLVQHQPTQYPTSEELSIGKIKFKAFDLGGHQIARRVWKDYYAKVDAVVYLVDAADKERFAESKKELDALLSDDSLANVPFLVLGNKIDIPYAASEDELRYHLGLSNFTTGKGKVNLADTNVRPLEVFMCSIVRKMGYGEGFRWMSQYIK

SEQ ID NO: 6411 - protein, 193 aa, Theobroma cacao
MFFLDWFYGVLASLGLWQKDAKILFLGLDNAGKTTLLHMLKDERLVQHQPTQHPTSEELSIGQIKFKAFDLGGHQIARRVWKDYYAKVDAVVYLVDAYDKERFAESKRELDALLSDEALANVPFLILGNKIDIPYAASEDELRHHLGLINFTTGKGKVNLGDSNVRPLEVFMCSIVRKMGYGDGFKWLSQYIK

SEQ ID NO: 6412 - protein, 193 aa, Theobroma cacao
  misc_feature (43)..(43): Xaa can be any naturally occurring amino acid
  misc_feature (164)..(164): Xaa can be any naturally occurring amino acid
MFLLDWFYGVLASLGLWQKEAKILFLGLDNAGKTTLLHMLKDXRLVQHQPTQHPTSEELSIGKIKFKAFDLGGHQIARRVWKDYYAKVDAVVYLVDAYDKERFAESKRELDALLSDEALANVPFLILGNKIDIPYAASEDELRYHLGLTNFTTGKGKVNFTDSXVRPLEVFMCSIVRKMGYGDGFKWLSQYIK

SEQ ID NO: 6413 - protein, 193 aa, Coffea canephora
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALANVPFLILGNKIDIPYAASEDELRYHLGLTGVTTGKGKVNLGDSNVRPLEVFMCSIVRKMGYGDGFKWVSQYIK

SEQ ID NO: 6414 - protein, 193 aa, Gossypium hirsutum
MFLLDWFYGVLASLGLWQKEAKILFLGLDNAGKTTLLHMLKDERLVQHQPTQYPTSEELNIGKIKFKAFDLGGHQIARRVWKDYYAKVDAMVYLVDAYDKERFAESKKELDALLSDEALANVPFLILGNKIDIPYAASEDELRYHLGLTNFTTGKGKVNLADSNVRPLEVFMCSIVRKMGYGNGFKWMSQYIK

SEQ ID NO: 6415 - protein, 193 aa, Gossypium hirsutum
  misc_feature (67)..(67): Xaa can be any naturally occurring amino acid
MFIFDWFYGILASLGLWQKEAKILFLGLDNAGKTTLLHMLKDERLVQHQPTQHPTSEELSIGKIKFXAFDLGGHQIARRVWKDYYAKVDAVVYLVDAYDKERFAESKRELDALLSDEALANVPFLILGNKIDIPYAASEDELRYHLGLTNFTTGKGKVNLGDSNVRPLEVFMCSIVRKMGYGDGFKWVSQYIK

SEQ ID NO: 6416 - protein, 193 aa, Gossypium hirsutum
  misc_feature (155)..(155): Xaa can be any naturally occurring amino acid
MFLVDWFYGILASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLANVPFLILGNKIDIPYAASEDELRYHLGLTNFTTGXGKVNLADSNVRPLEVFMCSIVRKMGYGDGFKWMSQYIN

SEQ ID NO: 6417 - protein, 193 aa, Mesembryanthemum crystallinum
MFLLDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDEALADVPFLILGNKIDIPYAASEEELRYHLGLSNCTTGKGKVNLAGSNVRPLEVFMCSIVRKMGYGDGFKWVSQYIN

SEQ ID NO: 6418 - protein, 193 aa, Actinidia deliciosa
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIPYAASEDELRYHMGLTGVTTGKGKVNLADSAVRPLEVFMCSIVRKMGYGDGFKWVSQYIK

SEQ ID NO: 6419 - protein, 193 aa, Mimulus guttatus
MFLLDWFYGVLASLGLWQKEAKILFLGLDNAGKTTLLHMLKDERLVQHQPTQYPTSEELSIGQIKFKAFDLGGHQIARRVWKDYYAKVDAVVYLVDAYDKERFAESKKELDALLSDEALADVPFLILGNKIDIPYAASEDELRYHLGLSGVTTGKGKVNLADSNVRPLEVFMCSIVRKMGYGDGFKWVSQYIK

SEQ ID NO: 6420 - protein, 193 aa, Carica papaya
MFIVDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKRELDALLSDEALVNVPFLILGNKIDIPYASSEDELRYHLGLTNFTTGKGKVNLTDSSVRPLEVFMCSIVRKMGYGDGFKWLSQYIK

SEQ ID NO: 6421 - protein, 193 aa, Pisum sativum
MFLVDWFYGVLASLGLWQKEAKILFLGLDNAGKTTLLHMLKDERLVQHQPTQYPTSEELSIGKIKFKAFDLGGHQIARRVWKDYYAQVDAVVYLVDAYDKERFAESKKELDALLSDESLANVPFLVLGNKIDIPYAASEDELRYNLGLSNFTTGKGKVNLADSNVRPMEVFMCSIVKKMGYGEGFKWVSQYIK

SEQ ID NO: 6422 - protein, 193 aa, Populus trichocarpa
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALANVPFLVLGNKIDIPDAASEDELRFYLGLTNFTTGKGKVNLVDSNVRPLEVFMCSIVRKMGYGEGFRWLSQYIK

SEQ ID NO: 6423 - protein, 193 aa, Populus trichocarpa
MFLVDWFYGVLASLGLWQKEAKILFLGLDNAGKTTLLHMLKDERLVQHQPTQYPTSEELSIGKIKFKAFDLGGHQIARRVWKDYYAKVDAVIYLVDAYDKERFAEAKKELDALLSDEALANVPFLVLGNKIDIPYAASEDELRYNLGLTNFTTGKGKVNLVDSNVRPLEVFMCSIVRKMGYGEGFRWLSQYIK

SEQ ID NO: 6424 - protein, 193 aa, Prunus persica
MFLVDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKDRFAESKKELDALLSDESLATVPFLVLGNKIDIPYAASEEELRYHLGLTNFTTGKGKVNLTDTTVRPLEVFMCSIVRKMGYGDGFKWVSQYIK

SEQ ID NO: 6425 - protein, 193 aa, Prunus persica
MFLFDWFYGVLASLGLWQKEAKILFLGLDNAGKTTLLHMLKDERLVQHQPTQYPTSEELSIGKIKFKAFDLGGHQIARRVWRDYYAKVDAVVYLVDAYDKERFAESKKELDALLSDEALANVPFLILGNKIDIPYAASEEELRHHLGLTNFTTGKGKVNLTDSNVRPLEVFMCSIVRKMGYGDGFKWLSQYIK

SEQ ID NO: 6426 - protein, 193 aa, Oryza sativa
MFLWDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDDSLAAVPFLILGNKIDIPYAASEEELRYHLGLSNFTTGKGKVSLGESNVRPLEVFMCSVVRKMGYGDGFKWVSQYIK

SEQ ID NO: 6427 - protein, 193 aa, Thellungiella halophila
MFLVDWFYGVLATLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLANVPFLVLGNKIDIPYAASEDELRYHLGLTNFTTGKGKVNLAGTNVRPLEVFMCSIVRKMGYGEGFKWVSQYID

SEQ ID NO: 6428 - protein, 193 aa, Unknown
  Sequence found in Organisms: Cucumis sativus, Cucumis melo
MFLVDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFTESKKELDALLSDEALADVPFLVLGNKIDIPYAASEDELRFHLGLSNFTTGKGKVNLTQTNVRPLEVYMCSIVRKMGYGDGFKWLSQYIK

SEQ ID NO: 6429 - protein, 193 aa, Unknown
  Sequence found in Organisms: Curcuma longa, Zingiber officinale
MFLVDWFYGVLASLGLWQKEAKILFLGLDNAGKTTLLHMLKDERLAQHQPTQYPTSEELSIGKIKFKAFDLGGHQIARRVWKDYYAKVDAVVYLVDAYDKERFAESKKELDALLSDDALANVPFLILGNKIDIPYAASEDELRFHLGLNNFTTGKGKVNLADSNVRPLEVFMCSIVRKMGYGDGFKWVSQYIK

SEQ ID NO: 6430 - protein, 193 aa, Unknown
  Sequence found in Organisms: Solanum melongena, Capsicum annuum
MFLVDWFYGILATLGLWQKEAKILFLGLDNAGKTTLLHMLKDERLVQHQPTQYPTSEELSIGKIKFKAFDLGGHQIARRVWKDYYAKVDAVVYLVDSYDKERFAESKKELDALLSDESLATVPFLILGNKIDIPYAASEDELRYHLGLTGVTTGKGKVNLADSNVRPLEVFMCSIVRKMGYGEGFRWMSQYIK

SEQ ID NO: 6431 - protein, 193 aa, Tropaeolum majus
MFLFDWFYGILSSLGLWQKEAKILFLGLDNAGKTTLLHMLKDERLVQHQPTQHPTSEELSIGKIKFKAFDLGGHQIARRVWKDYYAKVDAVVYLVDAYDKERFSESKRELDALLSDEALATVPFLILGNKIDIPYAASEDELRYHLGLTNFTTGKGKVALADSSVRPLEVFMCSIVRKMGYGDGFKWLSQYIK

SEQ ID NO: 6432 - protein, 190 aa, Quercus alba
MFLVDWFYGVLASLGLWQKEAKILFLGLDNAGKTTMLKDERLVQHQPTQHPTSEELSIGKIKFKAFDLGGHQIARRVWKDYYAKVDAVVYLVDAYDKERIAESKKELDALLSDESLANVPFLVLGNKIDIPYAASEDELRYHLGLTNFTTGKGKVILTESNVRPLEVFMCSIVRKMGYGEGFKWLSQYIK

SEQ ID NO: 6433 - protein, 193 aa, Cajanus cajan
MFLVDWFYGILASLGLWQKEAKILFLGLDNAGKTTLLHMLKDERLVQHQPTQYPTSEELSIGKIKFKAFDLGGHQIARRVWKDYYAQVDAVVYLVDAYDKERFAESKKELDALLSDESLANVPFLILGNKIDIPYAASEEELRYHLGLTNFTTGKGKVNLADSNVRPMEVFMCSIVKKMGYGDGFKWLSQYIK

SEQ ID NO: 6434 - protein, 193 aa, Salvia sclarea
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALATVPFLILGNKIDIPYAASEDELRFHLGLTGVTTGKGKVNLADSNVRPLEVFMCSIVRKMGYGDGFKWVSQYIN

SEQ ID NO: 6435 - protein, 193 aa, Tragopogon dubius
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIPYAASEDELRYHLGLTGLTTGKGKVNLENSGVRALEVFMCSIVRKMGYGDGFKWVSQYIK

SEQ ID NO: 6436 - protein, 193 aa, Amborella trichopoda
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAADKERFAESKKELDALLSDDSLAAVPFLVLGNKIDIPYAASEDELRYYLGLTNFTTGKGKVVLSDSNVRPLEVFMCSIVRKMGYGDGFKWLSQYIK

SEQ ID NO: 6437 - protein, 193 aa, Musa acuminata
  misc_feature (11)..(11): Xaa can be any naturally occurring amino acid
  misc_feature (121)..(121): Xaa can be any naturally occurring amino acid
MFIIDWFYGIXASLGLWQKEAKILFLGLDNAGKTTLLHMLKDERLVQHQPTQYPTSEELSIGKIKFKAFDLGGHQIARRVWKDYYAKVDAVVYLVDAADKERFAESKKELDALLSDDSLAXVPFLVLGNKIDIPYAASEDELRYHLGLSNFTTGKGKVNLADTNVRPLEVFMCSIVRKMGYGEGFRWMSQYIK

SEQ ID NO: 6438 - protein, 193 aa, Ocimum basilicum
MFLLDWFYGVRASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALATVPFLILGNKIDIPYAASEDELRYHLGLTGVTTGKGKVNLADSNVRPLEVFMCSIVRKMGYGDGFKWVSQYIN

SEQ ID NO: 6439 - protein, 193 aa, Manihot esculenta
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDSYDKERFAESKKELDALLSDEALANVPFLVLGNKIDIPYAASEDELRYHLGLTNFTTGKGNVNLGDSNVRPMEVFMCSIVRKMGYGDGFKWLSQYIK

SEQ ID NO: 6440 - protein, 193 aa, Manihot esculenta
MFLLDWFYGILASLGLWQKEAKILFLGLDNAGKTTLLHMLKDERLAQHQPTQYPTSEELSIGKIKFKAFDLGGHQIARRVWKDYYAKVDAVVYLVDAYDKERFAESKKELDGLLSDEALTDVPFLILGNKIDIPYAASEDELRYHLGLTNFTTGKGKVNLADSNVRPLEVFMCSIVRKMGYGDGFKWLSQYIK

SEQ ID NO: 6441 - protein, 193 aa, Ricinus communis
MFLLDWFYGVLASLGLYQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALANVPFLVLGNKIDIPYAASEDELRCHLGLANFTTGKGKVNLGDSNVRPLEVFMCSIVRKMGYGDGFKWLSQYIN

SEQ ID NO: 6442 - protein, 193 aa, Castanea mollissima
MFLFDWFYGVLASLGLWQKEAKILFLGLDNAGKTTLLHMLKDERLVQHQPTQYPTSEELSIGKIKFKAFDLGGHQIARRVWKDYYAKVDAVVYLVDACDKERFAESKKELDSLLSDEALANVPFLILGNKIDIPYAASEDDLRFHLGLTNFTTGKGKVNLADSNVRPLEVFMCSIVRKMGYGDGFKWLSQYIK

SEQ ID NO: 6443 - protein, 193 aa, Coffea canephora
MFLLDWFYGILASLGLWQKEAKILFLGLDNAGKTTLLHMLKDERLVQHQPTQYPTSEELSIGQIKFKAFDLGGHQIARRVWKDYYAKVDAVVYLVDAYDKERFAESKKELDALLSDESLANVPFLILGNKIDIPYAASEDELRYHMGLTGITTGKGKVNLADSNVRPLEVFMCSIVRKMGYGEGFKWMSQYIK

SEQ ID NO: 6444 - protein, 193 aa, Gossypium hirsutum
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKRELDALLSDEALANVPFLILGNKIDIPYAASEDELRYHLGLTNFTTGKGKVNLTNSSVRPLEVFMCSIVRKMGYGDGFKWVSQYIK

SEQ ID NO: 6445 - protein, 193 aa, Gossypium hirsutum
MFLLDWFYGVLASLGLWQKEAKILFLGLDNAGKTTLLHMLKDERLVQHQPTQYPTSEELNIGKIKFKAFDLGGHQIARRVWKDYYAKVDAMVYLVDAYDKERFAESKKELDALLSDEALANVPFLILGNKIDIPYAASEDELRYHLGLTNFTTGKGKVNLADSNVRPLEVSMCSIVRKMGYGNGFKWMSQYIK

SEQ ID NO: 6446 - protein, 193 aa, Vigna unguiculata
MFLFDWFYGILASLGLWQKEAKILFLGLDNAGKTTLLHMLKDERLVQHQPTQHPTSEELSIGKIKFKAFDLGGHQVARRVWKDYYAKVDAVVYLVDAYDKERFAESKKELDALLSDEGLAGVPFLVLGNKIDIPYAASEDELRYHLGLTNFTTGKGKINLTDSNLRPLEVFMCSIVRKMGYGEGFQWLSQYIK

SEQ ID NO: 6447 - protein, 193 aa, Eucalyptus gunnii
MFLLDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKRELDALLSDEALANVPFLVLGNKIDIPYAASEDELCYHLGLSNFTTGKGKVNLTDGNIRPVEVFMCSIVRKMGYGDGFKWLSQYIK

SEQ ID NO: 6448 - protein, 193 aa, Medicago truncatula
MFLVDWFYGVLASLGLWQKEAKILFLGLDNAGKTTLLHMLKDERLVQHQPTQYPTSEELSIGKIKFKAFDLGGHQIARRVWKDYYAQVDAVVYLVDAYDKERFAESKKELDALLSDESLANVPFLVLGNKIDIPYAASEDELRHHLGLSNFTTGKGKVNLSDSNVRPMEVFMCSIVKKMGYGDGFKWVSQYIK

SEQ ID NO: 6449 - protein, 193 aa, Cucumis melo
  misc_feature (31)..(31): Xaa can be any naturally occurring amino acid
  misc_feature (44)..(44): Xaa can be any naturally occurring amino acid
  misc_feature (88)..(88): Xaa can be any naturally occurring amino acid
MFLVDWFYGVLASLGLWQKEAKILFLGLDNXGKTTLLHMLKDEXLVQHQPTQHPTSEELSIGKIKFKAFDLGGHQIARRVWKDYYAKXDAVVYLVDAYDKERFTESKKELDALLSDEALADVPFLILGNKIDIPYAASEDELRYNLGLTNFTTGKGKVNLGDSNVRPLEVFMCSIVRKMGYGDGFKWLSQYIK

SEQ ID NO: 6450 - protein, 193 aa, Nuphar advena
  misc_feature (121)..(121): Xaa can be any naturally occurring amino acid
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAADKERFAESKKELDALLSDDSLAXVPFLVLGNKIDIPYAASEEELRYHLGLSNFTTGKGKVSLTDTNVRPLEVFMCSIVRKMGYGEGFKWMSQYIK

SEQ ID NO: 6451 - protein, 193 aa, Quercus alba
MFLFDWFYGILASLGLWQKEAKILFLGLDNSGKTTLLHMLKDERLVQHQPTQYPTSEELSIGQIKFKAFDLGGHQIARRVWKDYYAKVDAVVYLVDAYDRERFAESKKELDALLSDESLAAVPFLILGNKIDIPYAASEDELRYNMGLTNFTTGKGKVNLADSNVRPLEVFMCSIVRKMGYGEGFKWLSQYIK

SEQ ID NO: 6452 - protein, 193 aa, Arachis hypogaea
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKRELDALLSDESLANVPFLILGNKIDIPYAASEEELRYNMGLSNFTTGKGNVNLADTGVRPLEVFMCSIVRKMGYGEGFKWLSQYIK

SEQ ID NO: 6453 - protein, 192 aa, Populus trichocarpa
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERLAESKKELDALLSDEALANVPFLVLGNKIDIPYAASEEELRYHLGLVNFTTGKGKVNLGDSNVRPLEVFMCSIVRKMGYGEGFRWLSQYI

SEQ ID NO: 6454 - protein, 195 aa, Raphanus sativus
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFSESKKELDALLSDESLATVPFLILGNKIDIPYAASEDELRYHLGLTNFTTGKGKVTTAGGDSGVRPLEVFMCSIVRKMGYGEGFKWLSQYIN

SEQ ID NO: 6455 - protein, 193 aa, Unknown
  Sequence found in Organisms: Solanum lycopersicum, Solanum phureja
MFLWDWFYGVLSSLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALATVPFLILGNKIDIPYAASEDELRYHLGLTGVTTGKGKVNLADSTVRPLEVFMCSIVRKMGYGDGFKWVSQYIK

SEQ ID NO: 6456 - protein, 193 aa, Unknown
  Sequence found in Organisms: Sorghum bicolor, Saccharum officinarum
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDDSLATVPFLILGNKIDIPYAASEEELRYHMGLSNFTTGKGKVNLGESNVRPLEVFMCSVVRKMGYGDGFKWVSQYIN

SEQ ID NO: 6457 - protein, 193 aa, Glycine max
MFLFDWFYGILASLGLWQKEAKILFLGLDNAGKTTLLHMLKDERLVQHQPTQHPTSEELSIGKIKFKAFDLGGHQVARRVWKDYYAKVDAVVYLVDAFDKERFAESKKELDALLSDESLANVPFLVLGNKIDIPYAASEDELRYHLGLTNFTTGKGKMNLTDSNLRPLEVFMCSIVRKMGYGEGFQWLSQYIK

SEQ ID NO: 6458 - protein, 193 aa, Glycine max
MFLFDWFYGILASLGLWQKEAKILFLGLDNAGKTTLLHMLKDERLVQHQPTQHPTSEELSIGKIKFKAFDLGGHQVARRVWKDYYAKVDAVVYLVDAFDKERFAESKKELDALLSDESLANVPFLVLGNKIDIPYAASEDELRYHLGLTNFTTGKGKINLTDSNLRPLEVFMCSIVRKMGYGEGFQWLSQYIK

SEQ ID NO: 6459 - protein, 193 aa, Saccharum officinarum
  misc_feature (161)..(161): Xaa can be any naturally occurring amino acid
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDDSLATVPFLILGNKIDIPYAASEEELRYHMGLSNFTTGKGKVNLXESNVRPLEVFMCSVVRKMGYGDGFKWVSQYIN

SEQ ID NO: 6460 - protein, 193 aa, Helianthus annuus
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDENLAAVPFLILGNKIDIPYAASEDELRYHLGLTGVTTGKGKVNLQDSSVRPLEVFMCSIVRKMGYGDGFKWVSQYIK

SEQ ID NO: 6461 - protein, 193 aa, Panicum virgatum
MFLVDWLYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDDSLATVPFLILGNKIDIPYAASEEELRYHMGLSNFTTGKGNVNLGESNVRTLEVFMCSIVRKMGYGEGFKWVSQYIK

SEQ ID NO: 6462 - protein, 193 aa, Panicum virgatum
MFLVDWFYGVLASLGLWQKEAKILFLGLDNAGKTTLLHMLKDERLVQHQPTQYPTSEELSIGKIKFKAFDLGGHQIARRVWKDYYAKVDAVVFLVDAYDKERFSESKKELDALLSDDSLATVPFLILGNKIDIPYAASEEELRYHMGLSNFTTGKGNVNLGESNVRPLEVFMCSIVRKMGYGEGFKWVSQYIK

SEQ ID NO: 6463 - protein, 193 aa, Triphysaria pusilla
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEGLATVPFLILGNKIDIPYAASEDELRYHLGLTGVTTGKGKVNLADSNVRPIEVFMCSIVRKMGYGDGFKWASQYIN

SEQ ID NO: 6464 - protein, 193 aa, Triphysaria pusilla
MFLLDWFYGVLASLGLWQKEAKILFLGLDNAGKTTLLHMLKDERLVQHQPTQHPTSEELSIGKIKFKAFDLGGHQIARRVWKDYYAKVDAVVYLVDAFDKERFAESKKELDALLSDESLATVPFLILGNKIDIPYAASEEELRYQLGLMGITTGKGKVNLTDSNVRPTEVFMCSIVRKMGYGDGFKWVSQYIK

SEQ ID NO: 6465 - protein, 193 aa, Triphysaria pusilla
  misc_feature (43)..(43): Xaa can be any naturally occurring amino acid
MFLLDWFYGVLASLGLWQKEAKILFLGLDNAGKTTLLHMLKDXRLVQHQPTRHPTSEELSIGKIKFKAFDLGGHQIARRVWKDYYAKVDAVVYLVDAYDKERFAESKKELDALLSDESLATVPFLILGNKIDIPYAASEDELRYHLGLMGITTGKGVVNLTDSNVRPTEVFMCSIVRKMGYGDGFKWVSQYIK

SEQ ID NO: 6466 - protein, 195 aa, Unknown
  Sequence found in Organisms: Brassica napus, Brassica rapa, Raphanus sativus
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFSESKKELDALLSDEALATVPFLILGNKIDIPYAASEDELRYHLGLTNFTTGKGKVTTAGGDSGVRPLEVFMCSIVRKMGYGEGFKWLSQYIN

SEQ ID NO: 6467 - protein, 193 aa, Cleome spinosa
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKRELDALLSDEALANVPFLILGNKIDIPYAASEDELRYHLGLSNFTTGKGKVNLAGTNVRPLEVFMCSIVRKMGYGDGFKWVSQYIN

SEQ ID NO: 6468 - protein, 189 aa, Heritiera littoralis
DWFYGILASLGLWQKEAKILFLGLDNAGKTTLLHMLKDERLAQHQPTQHPTSEELSIGKIKFKAFDLGGHQIARRVWKDYYAKVDAVVYLVDAYDKERFAESKKELDALLSDEALANVPFLILGNKIDIPYAASEDELRYHLGLTNFTTGKGKINLGDSNVRPLEVFMCSIVRKMGYGDGFKWLSQYIN

SEQ ID NO: 6469 - protein, 193 aa, Ipomoea nil
MFLVDWFYGILASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLANVPFLILGNKIDIPYAASEDELQYHMGLTGITTGKGKVNLADTNVRPLEVFMCSIVRKMGYGEGFKWMSQYIK

SEQ ID NO: 6470 - protein, 193 aa, Unknown
  Sequence found in Organisms: Centaurea maculosa, Cichorium intybus, Cynara scolymus, Taraxacum officinale, Lactuca sativa, Carthamus tinctorius, Helianthus annuus
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDENLSAVPFLILGNKIDIPYAASEDELRYHLGLTGVTTGKGKVNLQDSSVRPLEVFMCSIVRKMGYGDGFKWVSQYIK

SEQ ID NO: 6471 - protein, 193 aa, Salvia sclarea
MFLFDWFYGILASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALATVPFLILGNKIDIPYAASEDELLYHLGLTGVTTGKGKVNLSDSNVRPLEVFMCSIVRKMGYGDGFKWVSQYIN

SEQ ID NO: 6472 - protein, 193 aa, Camellia sinensis
MFLFDWFYGILASLGLWQKEAKILFLGLDNAGKTTLLHMLKDERLVQHQPTQYPTSEELSIGKIKFKAFDLGGHQIARRVWKDYYAQVDAVVYLVDAYDKERFAESKKELDALLSDESLANVPFLILGNKIDIPYAASEDELRYYLGLTGITTGKGKVNLADSNVRPLEVFMCSIVRKMGYGDGFKWMSQYIK

SEQ ID NO: 6473 - protein, 193 aa, Unknown
  Sequence found in Organisms: Lactuca sativa, Tragopogon dubius
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDENLGAVPFLILGNKIDIPYAASEDELRYHLGLTGVTTGKGKVNLQDSSVRPLEVFMCSIVRKMGYGDGFKWVSQYIK

SEQ ID NO: 6474 - protein, 193 aa, Antirrhinum majus
MFLWDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLAAVPFLILGNKIDIPYAASEEELRYHLGLQGITTGKGKVNLADSNVRPIEVFMCSIVRKMGYGDGFKWVSQYIK

SEQ ID NO: 6475 - protein, 193 aa, Malus domestica
MFLLDWFNGVLASLGLWQKEAKILFLGLDNAGKTTLLHMLKDERLVQHQPTQYPTSEELSIGKIKFKAFDLGGHQIARRVWKDYYAKVDAVVNLVDAYDKERFAESKKELDALLSDESLAAVPFLVLGNKIDIPYAASEEELRFHLGLNNFTTGKGKVNLQDSNVRPLEVFMCSIVRKMGYGDGFQWLSQYIK

SEQ ID NO: 6476 - protein, 193 aa, Manihot esculenta
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDSYDKERFAESKKELDALLSDDALANVPFLILGNKIDIPYAASEDELRHHLGLTNFTTGKGKVNLGDSNVRPMEVFMCSIVRKMGYGDGFKWLSQYIN

SEQ ID NO: 6477 - protein, 193 aa, Manihot esculenta
  misc_feature (144)..(144): Xaa can be any naturally occurring amino acid
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDSYDKERFAESKKELDALLSDDALANVPFLILGNKIDIPYAASEDELRXHLGLTNFTTGKGKVNLGDSNVRPMEVFMCSIVRKMGYGDGFKWLSQYIN

SEQ ID NO: 6478 - protein, 193 aa, Cichorium intybus
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIAYAASEDELRYFLGLTGLTTGKGKVNLENSGVRPLEVFMCSIVRKMGYGDGFKWVSQYIK

SEQ ID NO: 6479 - protein, 193 aa, Gossypium hirsutum
  misc_feature (143)..(143): Xaa can be any naturally occurring amino acid
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKRELDALLSDEALANVPFLILGNKIDIPYAASEDELXYHLGLTNFTTGKGKVNLTNSSVRPLEVFMCSIVRKMGYGDGFKWVSQYIK

SEQ ID NO: 6480 - protein, 193 aa, Vigna unguiculata
MFLVDWFYGILASLGLWQKEAKILFLGLDNAGKTTLLHMLKDERLVQHQPTQYPTSEELSIGKIKFKAFDLGGHQIARRVWKDYYAQVDAVVYLVDAYDKERFAESKKELDALLSDESLANVPFLVLGNKIDIPYAASEEELRYHLGLTNFTTGKGKVNLADSNVRAMEVFMCSIVKKMGYGEGFKWLSQYIK

SEQ ID NO: 6481 - protein, 193 aa, Lotus japonicus
MFLFDWFYGILASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLANVPFLILGNKIDIPYAASEEELRYSLGLANFTTGKGKVNLSDSNVRPMEVFMCSIVKKMGYGDGFKWVSQYIK

SEQ ID NO: 6482 - protein, 193 aa, Arachis hypogaea
MFLFDWFYGILASLGLWQKEAKILFLGLDNAGKTTLLHMLKDERLVQHQPTQYPTSEELSIGKIKFKAFDLGGHQIARRVWRDYYAQVDAVVYLVDAYDKERFAESKKELDALLADESLAKVPFLILGNKIDIPYAASEEELRYHMGLTNFTTGKGKVNLADSNLRPLEVFMCSIVRKMGYGEGFKWLSQYIK

SEQ ID NO: 6483 - protein, 193 aa, Arachis hypogaea
MFLFDWFYGILASLGLWQKEAKILFLGLDNAGKTTLLHMLKDERLVQHQPTQHPTSEELSIGKIKFKAFDLGGHQVARRVWKDYYAKVDAVVYLVDAYDKERFAESKKELDALLSDEALANVPFLVLGNKIDIPYAASEEELRYHLGLTNFTTGKGKVNLTESNVRPLEVFMCSIVRKMGYGDGFKWVSQYIK

SEQ ID NO: 6484 - protein, 193 aa, Unknown
  Sequence found in Organisms: Solanum lycopersicum, Solanum tuberosum, Solanum phureja
MFLVDWFYGILATLGLWQKEAKILFLGLDNAGKTTLLHMLKDERLVQHQPTQYPTSEELSIGKIKFKAFDLGGHQIARRVWKDYYAKVDAVVYLVDSYDKERFAESKKELDALLSDESLATVPFLILGNKIDIPYAASEDELRYHLGLTGVTTGKGKVNLAESNVRPLEVFMCSIVRKMGYGEGFRWMSQYIK

SEQ ID NO: 6485 - protein, 193 aa, Oryza sativa
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAADKERFAESKKELDALLADDSLATVPFLILGNKIDIPYAASEEELRYYLGLSNFTTGKGNVNLADSNVRPLEIFMCSVVRKMGYGEGFKWMSQYIK

SEQ ID NO: 6486 - protein, 193 aa, Oryza sativa
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFSESKKELDALLSDDSLATVPFLILGNKIDIPYAASEEELRYHMGLSNFTTGKGRVSLGESNVRPLEVFMCSIVRKMGYGDGFKWVSQYIK

SEQ ID NO: 6487 - protein, 193 aa, Senecio madagascariensis
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDENLSAVPFLILGNKIDIPYAASEDELRYHLGLTGLTTGKGKVNLQDSSVRPLEVFMCSIVRKMGYGDGFKWVSQYIK

SEQ ID NO: 6488 - protein, 155 aa, Eucalyptus gunnii
  misc_feature (49)..(49): Xaa can be any naturally occurring amino acid
  misc_feature (62)..(63): Xaa can be any naturally occurring amino acid
MLKDERLVQHQPTQYPTSEELSIGKIKFKAFDLGGHQIARRVWKDYYAXVDAVVYLVDAYDXXRFAESKKELDALLSDEALANVPFLVLGNKIDIPYAASEDELRYHLGLTNFTTGKGKVNLADSNVRPLEVFMCSIVRKMGYGDGFKWLSQYIK

SEQ ID NO: 6489 - protein, 195 aa, Unknown
  Sequence found in Organisms: Brassica napus, Brassica juncea, Brassica rapa, Raphanus sativus
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFSESKRELDALLSDEALATVPFLILGNKIDIPYAASEDELRYHLGLTNFTTGKGKVTTAGGDSGVRPLEVFMCSIVRKMGYGEGFKWLSQYIN

SEQ ID NO: 6490 - protein, 147 aa, Ipomoea batatas
MFLLDWFYGILASLGLWQKEAKILFLGLDNAGKTTLLHMLKDERLVQHPPTQYPTSEELSIGKIKFKAFDLGGHQIARRVWKDYYAKVDAVVYLVDAYDKERFAESKKELDALLSDESLANVPFLILGNKIDIPYAASEDELRYYLA

SEQ ID NO: 6491 - protein, 58 aa, Cajanus cajan
MFLFDWFYGILASLGLWQKEAKILFLGLDNAGKTTLLHMLKDERLVQHQPTQHPTSKN

SEQ ID NO: 6492 - protein, 90 aa, Cajanus cajan
MFLFDWFYGILASLGLWQKEAKILFLGLDNAGKTTLLHMLKDERLVQHQPTQHPTSEELSIGKIKFKAFDLGGHQVARRVWKDYYARWMR

SEQ ID NO: 6493 - protein, 78 aa, Triphysaria pusilla
MFLLDWFYGVLASLGLWQKEAKILFLGLDNAGKTTLLHMLKDERLVQHQPTQYPTSEELSIGKIKFKAFDLGGHQYSP

SEQ ID NO: 6494 - protein, 64 aa, Cucumis melo
YFILIPLSGDFSGFIPYTFYHQSAIMFLVDWFYGVLASLGLWQKRLKFSFSASTMPAKPLCFTC

SEQ ID NO: 6495 - protein, 193 aa, Aquilegia formosa
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDSYDRERFTESKKELDALLSDESLATVPFLILGNKIDLQYAASEDELRLALGLNTFTTGKGKVNLTDSNVRPLEVFMCSIVRKMGYGEGFKWVSQYIK

SEQ ID NO: 6496 - protein, 193 aa, Ipomoea nil
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDEALASVPFLILGNKIDIPYAASEDELRYHLGLTGITTGKGKVNLADSSVRPIEVFMCSIVRKMGYGDGFKWVSQYIK

SEQ ID NO: 6497 - protein, 193 aa, Tropaeolum majus
MFLFDWFYGILASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDEGLVDVPFLVLGNKIDIPYAASEDELRYNLGLTNFTTGKGKVSLGDSNVRPLEVFMCSIVRKMGYGDGFKWLSQYIK

SEQ ID NO: 6498 - protein, 193 aa, Triphysaria pusilla
MFLLDWFYGVLSSLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEGLASVPFLILGNKIDIPYAASEDELRYHLGLMGVTTGKGKVNLADSNVRPIEVFMCSIVRKMGYGDGFKWVSQYIN

SEQ ID NO: 6499 - protein, 191 aa, Antirrhinum majus
MFLFDWFYGVLASLGLWQKEAKILFLGLDNAGKTTLLHMLKDERLVQHQPTQHPTSEELSIGKIKFKAFDLGGHQIARRVWKDYYAKVDAVVYLVDAFDKERFAESKKELDALLSDESLATVPFLILGNKIDIPYAASEDELRYELGLMGITTGKGKVNLADSNVRAIEVFMCSIVRKMGYGDGFKWVSQY

SEQ ID NO: 6500 - protein, 193 aa, Persea americana
MFLLDWIYGVLASLGLWQKEAKILFLGLDNAGKTTLLHMLKDERLVQHQPTQYPTSEELSIGKIKFKAFDLGGHRIARRVWKDYYAKVDAVVYLVDAFDKERFAESKKELDALLSDDSLANVPFLILGNKIDIPYAASEEELRYQLGLSNFTTGKGKVSLADTNVRPLEVFMCSIVRKMGYGDGFKWLSQYIK

SEQ ID NO: 6501 - protein, 193 aa, Ocimum basilicum
  misc_feature (11)..(11): Xaa can be any naturally occurring amino acid
  misc_feature (153)..(153): Xaa can be any naturally occurring amino acid
  misc_feature (159)..(159): Xaa can be any naturally occurring amino acid
MFLLDWFYGVXASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALATVPFLILGNKIDIPYAASEDELRYHLGLTGVTXGKGKVXLADSNVRPLEVFMCSIVRKMGYGDGFKWVSQYIN

SEQ ID NO: 6502 - protein, 193 aa, Phaseolus coccineus
MFLFDWFYGILASLGLWQKEAKILFLGLDNAGKTTLLHMLKDERLVQHQPTQYPTSEELSIGKIKFKAFDLGGHQIARRVWRDYYAQVDAVIYLVDAYDKERFSESKKELDALLSDESLANVPFLILGNKIDIPYAASEDELRYHMGLTNFTTGKGKVNLAESNVRPLEVFMCSIVRKMGYGEGFQWLSQYIK

SEQ ID NO: 6503 - protein, 193 aa, Phaseolus coccineus
MFLFDWFYGILASLGLWQKEAKILFLGLDNAGKTTLLHMLKDERLVQHQPTQHPTSEELSIGKIKFKAFDLGGHQVARRVWKDYYAKVDAVVYLVDAYDKERFAESKKELDALLSDEGLAGVPFLVLGNKIDIPYAASEEELRYHLGLTNFTTGKGKINLTESNLRPLEVFMCSIVRKMGYGEGFQWLSQYIK

SEQ ID NO: 6504 - protein, 193 aa, Phaseolus coccineus
MFLVDWFYGILASLGLWQKEAKILFLGLDNAGKTTLLHMLKDERLVQHQPTQYPTSEELSIGKIKFKAFDLGGHQIARRVWKDYYAQVDAVVYLVDAYDKERFAESKKELDALLSDESLVSVPFLVLGNKIDIPYAASEEELRYHLGLTNFTTGKGKVNLTDSNVRAMEVFMCSIVKKMGYGEGFKWLSQYIK

SEQ ID NO: 6505 - protein, 193 aa, Beta vulgaris
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAFDKERLSESKKELDALLSDEALANVPFLILGNKIDIPYAASEDELRYHLGLSSCTTGKGNVNLTDSNVRPLEIFMCSIVRKMGYGEGFKWMSQYIK

SEQ ID NO: 6506 - protein, 193 aa, Brachypodium distachyon
MFLVDWFYGVLATLGMWQKEAKILFLGLDNAGKTTLLHMLKDERLVQHQPTQYPTSEELSIGKIKFKAFDLGGHQIARRVWKDYYAKVDAVVYLVDAYDKERFAESKRELDALLSDDSLATVPFLILGNKIDIPYAASEEELRYHMGLSNFTTGKGKVNLGETNVRPLEVFMCSIVRKMGYGDGFKWMSQYIK

SEQ ID NO: 6507 - protein, 191 aa, Brassica napus
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFSESKRELDALLSDEALATVPFLILGNKIDIPYAASEDELRYHLGLTNFTTGKGKVTTAGVRPLEVFMCSIVRKMGYGEGFKWLSQYIN

SEQ ID NO: 6508 - protein, 192 aa, Cicer arietinum
MFLFDWFYGILASLGLWQKEAKILFLGLDNAGKTTLLHMLKDERLVQHQPTQHPTSEELSIGKIKFKAFDLGGHQIARRVWSDYYSQVDAVVYLVDAYDKERFTESKNELNALLSDGSLANVPFLILGNKIDIPYAASEDELRYHLGLTNFTTGKGKVNLSDSNVRPLEVFMCSIVRKMGYGEGFKWLSQYI

SEQ ID NO: 6509 - protein, 193 aa, Gossypium hirsutum
MFFLDWIYGILASLGLWQKEAKILFLGLDNAGKTTLLHMLKDERLVQHQPTQHPTSEELSIGKIKFKAFDLGGHQIARRVWKDYYAKVDAVVFLVDSYDKERFAESKRELDALLSDEALASVPFLILGNKIDIPYAASEDELRYHLGLTNFTTGKGKVNLGDSSVRPLEVFMCSIVRKMGYGDGFRWLSQYIK

SEQ ID NO: 6510 - protein, 193 aa, Cryptomeria japonica
MFLFDWFYGILASLGLWQKEAKILFLGLDNAGKTTLLHMLKDERLVQHQPTQYPTSEELSIGKIKFKAFDLGGHQIARRVWKDYYAKVDAVVYLVDAADKERFAESKKELDALLSDDSLTTVPFLILGNKIDIPYAASEEELRYYLGLANYTTGKGKVNLADSNVRPIEVFMCSIVRKMGYGEGFKWVSQYIK

SEQ ID NO: 6511 - protein, 193 aa, Cynara scolymus
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLASVPFLILGNKIDIPYAASEDELQYFMGLSGLTTGKGKVNLENSSVRPLEVFMCSIVRKMGYGEGFKWVSQYIK

SEQ ID NO: 6512 - protein, 193 aa, Actinidia deliciosa
MFLLDWFYGVLASLGLWQKEAKILFLGLDNAGKTTLLHMLKDERLVQHQPTQYPTSEELSIGKIKFKAFDLGGHQIARRVWKDYYAQVDAVVYLVDAYDKERFAESKKELDALLSDESLANVPFLVLGNKIDIPYAASEDELRYYLGLTGLTTGKGKVNLADTNVRPLEVFMCSIVRKMGYGDGFKWMSQYIK

SEQ ID NO: 6513 - protein, 193 aa, Lactuca sativa
  misc_feature (180)..(180): Xaa can be any naturally occurring amino acid
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDENLGAVPFLILGNKIDIPYAASEDELRYHLGLTGVTTGKGKVNLQDSSVRPLEVFMCSIVRKMXYGDGFKWVSQYIK

SEQ ID NO: 6514 - protein, 193 aa, Glycyrrhiza uralensis
MFLVDWFYGILASLGLWQKEAKILFLGLDNAGKTTLLHMLKDERLVQHQPTQYPTSEELSIGKIKFKAFDLGGHQIARRVWKDYYAQVDAVVYLVDAYDKERFAESKKELDALLSDESLANVPFLVLGNKIDIPYAASEEELRFHLGLTNFTTGKGKVNLSDSNVRPMEVFMCSIVKKMGYGDGFKWLSQYIK

SEQ ID NO: 6515 - protein, 193 aa, Lotus japonicus
MFLVDWFYGVLASLGLWQKEAKILFLGLDNAGKTTLLHMLKDERLVQHQPTQYPTSEELSIGKIKFKAFDLGGHQIARRVWKDYYAQVDAVVYLVDAYDKERFAESKKELDALLSDESLASVPFLVLGNKIDIPYAASEEELRYHLGLANFTTGKGKVNLSDTSVRPMEVFMCSIVKKMGYGEGFKWVSQYIK

SEQ ID NO: 6516 - protein, 193 aa, Arachis hypogaea
MFLFDWFYGILASLGLWQKEAKILFLGLDNAGKTTLLHMLKDERLVQHQPTQHPTSEELSIGKIKFKAFDLGGHQVARRVWKDYYAKVDAVVYLVDAYDKERFAESKKELDALLSDEALANVPFLVLGNKIDIPYAASEEELRYHLGLTNFTTGKGKINLTDSNLRPLEVFMCSIVRKMGYGDGFKWVSQYIK

SEQ ID NO: 6517 - protein, 193 aa, Capsicum annuum
MFLWDWFYGVLSSLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALATVPFLILGNKIDIPYAASEDELRYHLGLTGVTTGKGKMNLADSTVRPLEVFMCSIARKMGYGDGFKWVSQYIK

SEQ ID NO: 6518 - protein, 193 aa, Petunia hybrida
MFLVDWFYGILATLGLWHKEAKILFLGLDNAGKTTLLHMLKDERLVQHQPTQYPTSEELSIGKIKFKAFDLGGHQIARRVWKDYYAKVDAVIYLVDAYDKERFAESKKELDALLSDESLATVPFLILGNKIDIPYAASEDELRYHLGLTGVTTGKGKVNHADSNIRPLEVFMCSIVRKMGYGEGFRWLSQYIK

SEQ ID NO: 6519 - protein, 193 aa, Papaver somniferum
MFLFDWFYGVLASLGLWQKEAKILFLGLDNAGKTTLLHMLKDERLVQHQPTQYPTSEELSIGQIKFKAFDLGGHQIARRVWKDYYAKVDAVVYLVDAFDKERFAESKKELDALLSDESLATVPFLVLGNKIDIPYAASEEELCYHLGLTNFTSGKGKVNLTDSNVRPIEVFMCSIVRKMGYGDGFKWVSQYIK

SEQ ID NO: 6520 - protein, 193 aa, Solanum tuberosum
MFLVDWFYGILATLGLWQKEAKILFLGLDNAGKTTLLHMLKDERLVQHQPTQYPTSEELSIGKIKFKAFDLGGHQIARRVWKDYYAKVDAVVYLVDSYDKERFAESKKELDALLSDESLATVPFLILGNKIDIPYAASEDELRYHLGLTGVTTGKGKVNLAESNVRPLEVFMCSIVRKMGYGESFRWMSQYIK

SEQ ID NO: 6521 - protein, 193 aa, Carthamus tinctorius
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLATVPFLILGNKIDIPYAASEDELQYFMGLSGLTTGKGKVNLENSTVRPIEVFMCSIVRKMGYGEGFKWVSQYIK

SEQ ID NO: 6522 - protein, 193 aa, Glycine max
MFLFDWFYGILASLGLWQKEAKILFLGLDNAGKTTLLHMLKDERLVQHQPTQYPTSEELSIGRIKFKAFDLGGHQIARRVWKDYYAKVDAVVYLVDSYDKERFAESKKELDALLSDESLTTVPFLILGNKIDIPYAASEEELRYHLGLTNFTTGKGNVNLSDSNVRPMEVFMCSIVKKMGYGDGFKWLSQYIK

SEQ ID NO: 6523 - protein, 193 aa, Glycine max
MFLWDWFYGILASLGLWQKEAKILFLGLDNAGKTTLLHMLKDERLVQHQPTQYPTSEELSIGKIKFKAFDLGGHQIARRVWKDYYAQVDAVVYLVDAYDKERFAESKKELDALLSDESLANVPFLVLGNKIDIPYAASEEELRYHLGLTNFTTGKGKVNLSDSNVRPMEVFMCSIVKKMGYGDGFKWVSQYIK

SEQ ID NO: 6524 - protein, 193 aa, Glycine max
MFLWDWFYGILASLGLWQKEAKILFLGLDNAGKTTLLHMLKDERLVQHQPTQYPTSEELSIGKIKFKAFDLGGHQIARRVWKDYYAQVDAVVYLVDAYDKERFAESKKELDALLSDESLASVPFLVLGNKIDIPYAASEEELRYHLGLTNFTTGKGKVNLADSNVRPMEVFMCSIVKKMGYGDGFKWVSQYIK

SEQ ID NO: 6525 - protein, 193 aa, Glycine max
MFLFDWFYGILASLGLWQKEAKILFLGLDNAGKTTLLHMLKDERLVQHQPTQYPTSEELSIGRIKFKAFDLGGHQIARRVWKDYYAKVDAVVYLVDAYDKERFAESKKELDALLSDESLTTVPFLILGNKIDIPYAASEEELRYHLGLTNFTTGKGNVNLSDSKVRPMEVFMCSIVKKMGYGDGFKWLSQYIK

SEQ ID NO: 6526 - protein, 192 aa, Euphorbia esula
MFLLDWFYGVLSSLGLWQKEAKILFLGLDNAGKTTLLHMLKDERLVQHQPTQYPTSEELSIGKIKFKAFDLGGHQIARRVWKDYYAKVDAVVYLVDSNDKERFAESKKELDALLSDEALANVPFLILGNKIDIPYAASEDELRYHLGLTNFTTGKGKVNLSDTNVRPLEVFMCSIVRKMGYGDGFKWVSQYI

SEQ ID NO: 6527 - protein, 193 aa, Panicum virgatum
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAVDKERFAESKKELDALLADDSLANVPFLILGNKIDIPYAASEEELRYYLGLSNFTTGKGNVNLSDSNVRPLEIFMCSVVRKMGYGEGFKWMSQYIK

SEQ ID NO: 6528 - protein, 193 aa, Nicotiana tabacum
MFLWDWFYGVLSSLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALATVPFLILGNKIDIPYAASEDELRYHLGLTGVTTGKGKVSVADSSVRPLEVFMCSIVRKMGYGDGFKWVSQYIK

SEQ ID NO: 6529 - protein, 193 aa, Nicotiana tabacum
MFLWDWFYGVLSSLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDEALSTVPFLILGNKIDIPYAASEDELRYHLGLTGVTTGKGKANLADSNVRPLEVFMCSIVRKMGYGDGFKWVSQYIK

SEQ ID NO: 6530 - protein, 193 aa, Juglans hindsii x Juglans regia
  misc_feature (98)..(98): Xaa can be any naturally occurring amino acid
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAXDNKRFAESKKELDALLSDEALANVPFLILGNKIDIPYAASEDELQYHLGLTNLTTGKGKVNLADSNIRPLEVFMCSIVRKMGYGDGFKWLSQYIK

SEQ ID NO: 6531 - protein, 195 aa, Raphanus sativus
MFFFDWFYGILASLGLWQKEAKILFLGLDNAGKTTLLHMLKDERLVQHQPTQHPTSEELSIGNIKFKAFDLGGHQIARRVWKDYYAKVDAVVYLVDAYDKERFSESKRELDALLSDEALATVPFLILGNKIDIPYAASEDELRYHLGLTNFTTGKGKVTTAGGDSGVRPLEVFMCSIVRKMGYGEGFKWLSQYIN

SEQ ID NO: 6532 - protein, 147 aa, Castanea mollissima
MFLFDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKSWMLSSLMRPWQLFHSLFLATRSIYHMLPQKMNCVSTLA

SEQ ID NO: 6533 - protein, 193 aa, Manihot esculenta
MFLLDWFYGILSSLGLWQKEAKILFLGLDNAGKTTLLHMLKDERLVQHQPTQYPTSEELSIGKIKFKAFDLGGHQIARRVWKDYYAKVDAVVYLVDAYDKERFAESKRELDALLSDEALANVPFLILGNKIDIPYAASEDELRHHLGMTSFTTGKGKVNLADTNVRPLEVFMCSIVRKMGYGDGFKWLSQYIK

SEQ ID NO: 6534 - protein, 193 aa, Curcuma longa
MFLVDWFYGVLASLGLWQKEAKILFLGLDNAGKTTLLHMLKDERLVQHQPTQYPTSEELSIGRIKFKAFDLGGHQIARRVWKDYYAKVDAVVYLVDAYDKERFAESKNELDALLSDDALANVPFLILGNKIDIQYAASEDELRFHLGLNNFTTGKGNVNLADSNVRPLEVFMCSIVRKMGYGDGFKWVSQYIK

SEQ ID NO: 6535 - protein, 193 aa, Pennisetum glaucum
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAVDKERFAESKKELDALLADDSLANVPFLILGNKIDIPYAASEEELRYYLGLNNFTTGKGNVNLSDSNVRPLEIFMCSVVRKMGYGEGFKWMSQYIK

SEQ ID NO: 6536 - protein, 192 aa, Orobanche aegyptiaca
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDANDKERFAESKKELDALLSDEVLANVPFLILGNKIDIPYAASEDELRYHLGLTGVTTGKGKVNLADSNMRPVEVFMCSIVRKMGYGDGFKWVSQYI

SEQ ID NO: 6537 - protein, 193 aa, Tragopogon dubius
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLATVPFLILGNKIDIPYASSEDELRYFMGLTGLTTGKGKVNLENSGVRPLEVFMCSIVRKMGYGDGFKWVSQYIK

SEQ ID NO: 6538 - protein, 193 aa, Unknown
  Sequence found in Organisms: Phaseolus coccineus, Vigna unguiculata
MFLFDWFYGILASLGLWQKEAKILFLGLDNAGKTTLLHMLKDERLVQHQPTQHPTSEELSIGKIKFKAFDLGGHQVARRVWKDYYAKVDAVVYLVDAYDKERFTESKKELDALLSDESLANVPFLVLGNKIDIPYAASEEELRYHLGLTNFTTGKGKVNLTESNLRPLEVFMCSIVRKMGYGDGFQWVSQYIK

SEQ ID NO: 6539 - protein, 193 aa, Unknown
  Sequence found in Organisms: Centaurea maculosa, Carthamus tinctorius
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLGSVPFLILGNKIDIPYAASEDELRYHMGLTGLTTGKGKVNLENSGVRPLEVFMCSIVRKMGYGDGFKWVSQYIK

SEQ ID NO: 6540 - protein, 193 aa, Centaurea maculosa
  misc_feature (185)..(185): Xaa can be any naturally occurring amino acid
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLATVPFLILGNKIDIPYAASEDELQYFMGLSGLTTGKGKVNLENSSVRPIEVFMCSIVRKMGYGEGXKWVSQYIK

SEQ ID NO: 6541 - protein, 193 aa, Lactuca sativa
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLANVPFLVLGNKIDIPYASSEDELRYFLGLTGLTTGKGKVNLENSGVRPLEVFMCSIVRKMGYGDGFKWVSQYIK

SEQ ID NO: 6542 - protein, 193 aa, Unknown
  Sequence found in Organisms: Zea mays, Sorghum bicolor
MFLVDWFYGVLASLGLWQKEAKILFLGLDNAGKTTLLHMLKDERLVQHQPTQYPTSEELSIGRIKFKAFDLGGHQIARRVWKDYYAKVDAVVYLVDAVDKERFAESKKELDALLADDSLANVPFLILGNKIDIPYAASEEELRYYLGLSNFTTGKGNVNLADSNVRPLEIFMCSVVRKMGYGEGFKWMSQYIK

SEQ ID NO: 6543 - protein, 193 aa, Carica papaya
MFLFDWFYGILASLGLWKKEAKILFLGLDNAGKTTLLHMLKDERLVQHQPTQYPTSEELSIGQINFKAFDLGGHQIARRVWKDYYAKVDAVVYLVDAYDKERFAESKKELDALLADEALVNVPFLILGNKIDIPYAASEDELRCHLGLTNFTTGKGKVNLGDSNVRPLEVFMCSIVRKMGYGDGFKWLSQYIK

SEQ ID NO: 6544 - protein, 193 aa, Pinus taeda
MFLFDWFYSVLATLGLWQKEAKILFLGLDNAGKTTLLHMLKDERLVQHQPTQYPTSEELSIGKIKFKAFDLGGHQIARRVWKDYYAKVDAVVYLVDAADKERFAEAKKELDALLSDDSLTNVPFLILGNKIDIPYAASEDELRYYLGLSNYTTGKGKVNLADSNVRPIEVFMCSIVRKMGYGEGIKWLSQYIK

SEQ ID NO: 6545 - protein, 193 aa, Raphanus sativus
MFLFDWFYGILATLGLWQKEAKILFLGLDNAGKTTLLHMLKDERLVQHQPTQHPTSEELSIGKIKFKAFDLGGHQIARRVWKDYYAKVDAVVYLVDAYDKERFVESKRELDALLSDEGLANVPFLILGNKIDIPYAASEDELRYHLGLTNFTTGKSNVNLEESGVRPLEVFMCSIVRKMGYGEGFKWLSYYIK

SEQ ID NO: 6546 - protein, 193 aa, Glycine max
MFFFDWFYGILASLGLWQKEAKILFLGLDNAGKTTLLHMLKDERLVQHQPTQHPTSEELSIGKIKFKAFDLGGHQVARRVWKDYYAKVDAVVYLVDAFDKERFAESKKELDALLSDESLANVPFLVLGNKIDIPYAASEEELRYHLGLTNFTTGKGKVNLTESNLRPLEVFMCSIVRKMGYGDGFQWVSQYIK

SEQ ID NO: 6547 - protein, 193 aa, Glycine max
MFLVDWFYGILATLGLWQKEAKILFLGLDNSGKTTLLHMLKDERLVQHQPTQYPTSEELSIGKIKFKAFDLGGHQIARRVWKDYYAQVDAVVYLVDAFDKERFSESKKELDALLSDESLANVPFLILGNKIDIPYAASEDELRYHMGLTNFTTGKGKVNLAESNVRPLEVFMCSIVRKMGYGEGFQWLSQYIK

SEQ ID NO: 6548 - protein, 193 aa, Picea glauca
MFLFDWFYGILATLGLWQKEAKILFLGLDNAGKTTLLHMLKDERLVQHQPTQYPTSEELSIGKIKFKAFDLGGHQIARRVWKDYYAKVDAVVYLVDAADKERFAESKKELDALLSDDSLTNVPFLILGNKIDIPYAASEDELRYYLGLSNYTTGKGKVNLADSNVRAIEVFMCSIVRKMGYGEGIKWLSQYIK

SEQ ID NO: 6549 - protein, 193 aa, Helianthus annuus
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIVYAASEDELLYHMGLTGLTTGKGKVNLENSGVRPIEVFMCSIVRKMGYGDGFKWVSQYIK

SEQ ID NO: 6550 - protein, 193 aa, Helianthus annuus
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIPYAASEDELRHFMGLTGLTTGKGKVNLENTSVRPLEVFMCSIVRKMGYGDGFKWVSQYIK

SEQ ID NO: 6551 - protein, 193 aa, Camellia sinensis
MFLFDWFYGILASLGLWQKEAKILFLGLDNAGKTTLLHMLKDERLVQHQPTQYPTSEELSIGQIKFKAFDLGGHQIARRVWKDYYAKVDAVVYLVDAYDKERFAESKKELDALLSDESLATVPFLILGNKIDIPYAASEDELRYSMGLTGITTGKGKVNLADSAVRPIEVFMCSIVRKMGYGDGFKWVSQYIK

SEQ ID NO: 6552 - protein, 193 aa, Nicotiana tabacum
MFLVDWFYGILATLGLWQKEAKILFLGLDNAGKTTLLHMLKDERLVQHQPTQYPTSEELSIGKIKFKAFDLGGHQIARRVWKDYYAKVDAVVYLVDSFDKERFAESKKELDALLSDESLATVPFLILGNKIDIPYAASEDELRYHMGLTGVTTGKGKVNLADSNVRPVEVFMCSIVRKMGYGEGFRWMSQYIK

SEQ ID NO: 6553 - protein, 157 aa, Camellia sinensis
MFLFDWFYGILASLGLWQKEAKILFLGLDNAGKTTLLHMLKDERLVQHQPTQYPTSEELSIGQIKFKAFDLGGHQIARRVWKDYYAKVDAVVYLVDAYDKERFAESKKELDALLSDESLATVPFLILGNKIDIPYAASEDELRYSMGLTGITTGKGR

SEQ ID NO: 6554 - protein, 193 aa, Brachypodium distachyon
MFLVDWFYGVLASLGLWQKEAKILFLGLDNAGKTTLLHMLKDERLVQHQPTQYPTSEELSIGQIKFKTFDLGGHQIARRVWKDYYAKVDAVVYLVDAADKERFAESKKELDGLLSDDSLAKVPFLVLGNKIDIPIAASEEELRYYLGLSNFTTGKGNVNLSDSNVRPLEVFMCSIVRKMGYGEGFKWMSQYIK

SEQ ID NO: 6555 - protein, 193 aa, Gossypium hirsutum
MFLVDWFYGILASLGLYQKEAKILFLGLDNAGKTTLLHMLKDERLVQHQPTQYPTSEELSIGMIKFKAFDLGGHQIARRVWKDYYAKVDAVVYLVDAYDKERFAESKKELDALLSDESLADVPFLILGNKIDLPYAASEDELRFHMGLTNFTTGKGKVNLEGTNVRPLEVFMCSIVRKMGYGDGFRWLSQYIK

SEQ ID NO: 6556 - protein, 193 aa, Taraxacum officinale
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDRERFAEAKKELDALLSDESLATVPFLILGNKIDLNYAASEDELRYHMGLTGLTTGKGKVNLENSGVRPLEVFMCSIVRKMGYGDGFKWVSQYIK

SEQ ID NO: 6557 - protein, 193 aa, Ipomoea nil
MFLLDWFYGIWASLGLWQKEAKILFLGLDNAGKTTLLHMLKDERLVQHQPTQYPTSEELSIGKIKFKAFDLGGHQIARRVWKDYYAKVDSVVYLVDAYDKERFAESKKELDALLSDESLANVPFLILGNKIDIPYAASEDELQYYLGLSGVTTGKGNVNLADSNVRPIEVFMCSIVRKMGYGEGFRWMSQYIK

SEQ ID NO: 6558 - protein, 193 aa, Cajanus cajan
MFLFDWFYGILATLGLWQKEAKILFLGLDNAGKTTLLHMLKDERLVQHQPTQYPTSEELSIGKIKFKAFDLGGHQIARRVWRDYYAQVDAVIYLVDAFDKERFSESKRELDALLSDESLANVPFLILGNKIDIPYAASEDELRYHMGLTNFTTGKGKVNLADSNVRPLEVFMCSIVRKMGYGEGFQWLSQYIK

SEQ ID NO: 6559 - protein, 193 aa, Antirrhinum majus
  misc_feature (16)..(16): Xaa can be any naturally occurring amino acid
  misc_feature (169)..(169): Xaa can be any naturally occurring amino acid
  misc_feature (171)..(171): Xaa can be any naturally occurring amino acid
MFLFDWFYGVLASLGXWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEGLTNVPFLILGNKIDIPYAASEDELRFHLGLTGVTTGKGKVNLADSNVRPLXVXMCSIVRKMGYGDGFKWVSQYIK

SEQ ID NO: 6560 - protein, 193 aa, Artemisia annua
MFLLDWFYGVLASLGLWQKEAKILFLGLDNAGKTTLLHMLKDERLVQHQPTQYPTSEELSIGQIKFKAFDLGGHQIARRVWKDYYAKVDAVVYLVDAYDKERFAESKKELDALLSDESLATVPFLILGNKIDIPYAASEEELSYHMGLQGSTTGKGKVNLENTGVRPLEVFMCSIVRKMGYGDGFKWVSQYIK

SEQ ID NO: 6561 - protein, 193 aa, Unknown
  Sequence found in Organisms: Brassica napus, Brassica juncea, Brassica rapa, Raphanus sativus
MFLFDWFYGILATLGLWQKEAKILFLGLDNAGKTTLLHMLKDERLVQHQPTQHPTSEELSIGKIKFKAFDLGGHQIARRVWKDYYAKVDAVVYLVDAYDKERFVESKRELDALLSDEALASVPFLILGNKIDIPYAASEDELRYHLGLTNFTTGKSNVSLGESGVRPLEVFMCSIVRKMGYGEGFKWLSYYIK

SEQ ID NO: 6562 - protein, 193 aa, Unknown
  Sequence found in Organisms: Hordeum vulgare, Pseudoroegneria spicata, Secale cereale, Triticum aestivum
MFLVDWFYGVLASLGLWQKEAKILFLGLDNAGKTTLLHMLKDERLVQHQPTQYPTSEELSIGQIKFKTFDLGGHQIARRVWKDYYAKVDAVVYLVDAADKERFAESKKELDGLLSDDSLANVPFLVLGNKIDIPIAASEEELRYYLGLSNFTTGKGNVNLSDSNVRPLEVFMCSIVRKMGYGEGFKWMSQYIK

SEQ ID NO: 6563 - protein, 193 aa, Ipomoea nil
  misc_feature (157)..(157): Xaa can be any naturally occurring amino acid
  misc_feature (162)..(162): Xaa can be any naturally occurring amino acid
MFLLDWFYGILASLGLWQKEAKILFLGLDNAGKTTLLHMLKDERLVQHQPTQYPTSEELSIGKIKFKAFDLGGHQIARRVWKDYYAKVDSVVYLVDAYDKERFAESKKELDALLSDESLANVPFLILGNKIDIPYAASEDELQYYLGLSGVTTGKGXVNLAXSNVRPIEVFMCSIVRKMGYGEGFRWMSQYIK

SEQ ID NO: 6564 - protein, 193 aa, Actinidia deliciosa
MFLFDWFYGILASLGLWQKEAKILFLGLDNAGKTTLLHMLKDERLVQHQPTQYPTSEELSIGQIKFKAFDLGGHQIARRVWKDYYAKVDAVVYLVDAYDKERFAESKKELDALLSDESLGNVPFLILGNKIDIPYAASEDELRYHMGLTGVTTGKGKVNLAESGVRPLEVFMCSIVRKMGYGDGFKWVSQYIK

SEQ ID NO: 6565 - protein, 193 aa, Lotus japonicus
MFLFDWFYGILATLGLWQKEAKILFLGLDNAGKTTLLHMLKDERLVQHQPTQYPTSEELSIGKIKFKAFDLGGHQIARRVWKDYYAQVDAVIYLVDAYDKERFAESKKELDALLSDDSLADVPFLILGNKIDIPYAASEDELRYHLGLTGLTTGKGKVNMADSKVRPLEVFMCSIVRKMGYGEGFQWLSQYIK

SEQ ID NO: 6566 - protein, 193 aa, Medicago truncatula
MFVFDWFYGILATLGLWQKEAKILFLGLDNAGKTTLLHMLKDERLVQHQPTQHPTSEELSIGRIKFKAFDLGGHQIARRVWRDYYAQVDAVVYLVDAFDKERFPESKKELDALLADESLGNVPFLILGNKIDITYAASEDELRYHLGLTNFTTGKGKINLSDSNVRPLEVFMCSIVRKMGYGEGFQWLSQYIK

SEQ ID NO: 6567 - protein, 193 aa, Populus trichocarpa
MFLFDWFFGVLTSLGLWQKEAKILFLGLDNSGKTTLLFMLKDERLVQHQPTQYPTSEELSIGNIKFKAFDLGGHQIARRVWKDYYAKVDAVIYLVDAYDKERFAEAKKELDALLSDEALANVPFLVLGNKIDIPYAASEDELRYNLGLTNFTTGKGKVNLVDSNVRPLEVFMCSIVRKMGYGEGFRWLSQYIK

SEQ ID NO: 6568 - protein, 193 aa, Raphanus sativus
MFLFDWFYGILATLGLWQKEAKILFLGLDNAGKTTLLHMLKDERLVQHQPTQHPTSEELSIGKIKFKAFDLGGHQIARRVWKDYYAKVDAVVYLVDAYDKERFVESKRELDALLSDEALASVPFLILGNKIDIPYAASEDELRYHLGLTNFTTGKSNVSLKESGVRPLEVFMCSIVRKMGYGEGFKWLSYYIK

SEQ ID NO: 6569 - protein, 193 aa, Raphanus sativus
MFLFDWFYGILATLGLWQKEAKILFLGLDNAGKTTLLHMLKDERLVQHQPTQHPTSEELSIGKIKFKAFDLGGHQIARRVWKDYYAKVDAVVYLVDAYDKERFVESKRELDALLSDEALANVPFLILGNKIDIPYAASEDELRYHLGLTNFTTGKSNVSLGESGVRPLEVFMCSIVRKMGYGEGFKWLSYYIK

SEQ ID NO: 6570 - protein, 193 aa, Senecio madagascariensis
MFLFDWFYGILASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLSAVPFLILGNKIDIPYAASEDELRHYLGLTGLTTGKGKVNLQESSVRPLEVFMCSIVRKMGYGDGFKWVSQYIK

SEQ ID NO: 6571 - protein, 193 aa, Senecio madagascariensis
MFLVDWFYGVLASLGLWQKEAKILFLGLDNAGKTTLLHMLKDERLVQHQPTQYPTSEELSIGQIKFKAFDLGGHQIARRVWKDYYAKVDAVVYLVDAYDKERFAESKKELDALLSDESLASVPFLILGNKIDIPLAASEEELRHYLGLTGLTTGKGKVNLENSGVRPLEVFMCSIVRKMGYGEGFKWVSQYIK

SEQ ID NO: 6572 - protein, 193 aa, Glycine max
MFFFDWFYGILASLGLWQKEAKILFLGLDNAGKTTLLHMLKDERLVQHQPTQHPTSEELSIGKIKFKAFDLGGHQVARRVWKDYYAKVDAVVYLVDAFDKERFAESKKELDALLSDESLANVPFLVLGNKIDIPYAASEEELRYHLGLTNFTTGKGKVNITESNLRPLEVFMCSIVRKMGYGDGFQWVSQYIK

SEQ ID NO: 6573 - protein, 193 aa, Saccharum officinarum
MFLVDWLYGVLASLGLWQKEAKILFLGLDNAGKTTLLHMLKDERLVQHQPTQYPTSEELSIGRIKFKAFDLGGHQIARRVWKDYYAKVDAVVYLVDAVDKERFAESKKELDALLADDSLANVPFLILGNKIDIPYAASEEELRYYLGLSNFTTGKGNVNLADSNVRPLEIFMCSVVRKMGYGEGFKWMSQYIK

SEQ ID NO: 6574 - protein, 193 aa, Helianthus annuus
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDILYAASEEELLYHMGLTGLTTGKGKVNLENSGVRPIEVFMCSIVRKMGYGDGFKWVSQYIK

SEQ ID NO: 6575 - protein, 193 aa, Arabidopsis lyrata
MFLFDWFYGIFASLGLWQKEAKILFLGLDNAGKTTLLHMLKDERLVQHQPTQHPTSEELSIGKIKFKAFDLGGHQIARRVWKDYYAKVDAVVYLVDAYDRERFVESKRELDALLSDEALANVPCLILGNKIDIPYASSEDELRYHLGLTNFTTGKGNVSLENSGVRPLEVFMCSIVRKMGYGEGFKWLSQYIK

SEQ ID NO: 6576 - protein, 193 aa, Cynodon dactylon
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAVDKERFAESKKELDALLADDSLTKVPFLILGNKIDIPYAASEEELRYYLGLNNFTTGKGNVNLDNSNVRPLEIFMCSVVRKMGYGEGFKWMSQYIK

SEQ ID NO: 6577 - protein, 193 aa, Tropaeolum majus
MFLFDWFYGILASLGLLQKEAKILFLGLDNAGKTTLLHMLKDERLVQHQPTQYPTSEELSVGKIKFKAFDLGGHQIARRVWKDYYAKVDAVVYLVDAYDKERFAESKKELDALLSDEALADVPFLVLGNKIDLQYAASEDELRYNLGLTNFTTGKGKVSLGDSNVRPLEVFMCSIVRKMGYGDGFKWVSQYIK

SEQ ID NO: 6578 - protein, 193 aa, Brassica napus
MFLFDWFYGILATLGLWQKEAKILFLGLDNAGKTTLLHMLKDERLVQHQPTQHPTSEELSIGKIKFKAFDLGGHQIARRVWKDYYAKVDAVVYLVDAYDKERFVESKRELDALLSDEALASVPFLILGNKIDIPYAASEDEMRYHLGLTNFTTGKSNVSLGESGVRPLEVFMCSIVRKMGYGEGFKWLSYYIK

SEQ ID NO: 6579 - protein, 193 aa, Brassica napus
MFLFDWFYGILATLGLWQKEAKILFLGLDNAGKTTLLHMLKDERLVQHQPTQHPTSEELSIGKIKFKAFDLGGHQIARRVWKDYYAKVDAVVYLVDAYDKERFVESKRELDALLSDEALSSVPFLILGNKIDIPYAASEDELRYHLGLTNFTTGKSNVSLEESGVRPLEVFMCSIVRKMGYGEGFKWLSYYIK

SEQ ID NO: 6580 - protein, 192 aa, Centaurea maculosa
  misc_feature (180)..(180): Xaa can be any naturally occurring amino acid
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLGSVPFLILGNKIDIPYAASEDELRYHMGLTGLTTGKGKVNLENSGVRPLEVFMCSIVRKMXYGDGFKWVSQYI

SEQ ID NO: 6581 - protein, 193 aa, Lactuca sativa
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDRERFAESKKELDALLSDESLANVPFLILGNKIDLNYAASEEELRFHLGLTGLTTGKGKVNLENSGVRPLEVFMCSIVRKMGYGDGFKWVSQYIK

SEQ ID NO: 6582 - protein, 193 aa, Glycyrrhiza uralensis
MFLFDWFYGILASLGLWQKEAKILFLGLDNAGKTTLLHMLKDERLVQHQPTQHPTSEELSIGKIKFKAFDLGGHQVARRVWRDYYAKVDAVVYLVDAFDKERFAESKKELDSLLSDEALANVPFLVLGNKIDIPYAASEEELRYHLGLTNFTTGKGKVNLNESNLRPLEVFMCSIVRKMGYGEGFRWVSQYIK

SEQ ID NO: 6583 - protein, 193 aa, Mimulus guttatus
MFLFDWFYGVLATLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLYDDSLANVPFLILGNKIDIPYAASEEELSYHLGLMGITSGKGKVNLSDSNVRPIEVFMCSIVRKMGYGDGFKWVSQFIK

SEQ ID NO: 6584 - protein, 188 aa, Euphorbia esula
MFLLDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDESLQTVPFLILGNKIDIPYAASEEELRFHLGLTNFTTGKGKVPLTETNVRPLEVFMCSIVRKMGYGDGFKWV

SEQ ID NO: 6585 - protein, 193 aa, Nicotiana tabacum
MFVLDWFYGVLASLGLWQKDAKILFLGLDNAGKTTLLHMLKDERLVQHQPTQYPTSEELSIGKIKFKAFDLGGHQIARRVWRDYYAKVDAVVYLVDAYDRERFPESKKELDGLLSDESLANVPFLILGNKIDIPYAASEDELRYHLGLTGVTTGKGNVNLAGTNVRPIEVFMCSIVRKMGYGEGFKWMSQYIK

SEQ ID NO: 6586 - protein, 157 aa, Musa acuminata
MFLIDWFYGILASLGLWQKEAKILFLGLDNAGKTTLLHMLKDERLVQHQPTQYPTSEELSIGKIKFKAFDLGGHQIARRVWKDYYAKVDAVVYLVDAADKERFAESKKELDALLSDDALANVPFLILGNKIDIPYAASEDELRYHLGLSNFTTGKGK

SEQ ID NO: 6587 - protein, 175 aa, Cynara scolymus
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLGSVPFLILGNKIDIPYAASEDELRYHMGLTGLTTGKGKVNLEILGFGLLRYSCVAL

SEQ ID NO: 6588 - protein, 93 aa, Allium cepa
MFLVDWFYGVLASLGLWQKEAKILFLGLDNAGKTTLLHMLKDERLVQHQPTQYPTSEELSIGKIKFKAFDLGGHQIARRVWKDYYARLMQLCT

SEQ ID NO: 6589 - protein, 193 aa, Avena sativa
MFLVDWFYGVLASLGLWQKEAKILFLGLDNAGKTTLLHMLKDERLVQHQPTQYPTSEELSIGQIKFKTFDLGGHQIARRVWKDYYAKVDAVVYLVDAADKERFAESKKELDGLLSDDSLVKVPILVLGNKIDIPIAASEEELRYYLGLSNFTTGKGNVNLSDSNVRPLEVFMCSIVRKMGYGEGFKWMSQYIK

SEQ ID NO: 6590 - protein, 193 aa, Capsicum annuum
MFLVDWFYGVLASLGLWQKDAKILFLGLDNAGKTTLLHMLKDERLVQHQPTQYPTSEELSIGNIKFKAFDLGGHQIARRVWRDYYAKVDAVVYLVDAYDRERFPESKKELDGLLSDESLANVPFLILGNKIDIPYAASEDELRYHLGLTGVTTGKGNVNLADTNVRPIEVFMCSIVRKMGYGEGFKWMSQYIK

SEQ ID NO: 6591 - protein, 200 aa, Quercus alba
MFLFDWFYGILASLGLWQKEAKILFLGLDNAGKTTLLFMLKDERLVQHQPTQYPTSEELSIGQIKFKAFDLGGHQIARRVWKDYYAKVDAVVYLVDAYDKERFAESKKELDALLSDESLATVPFLILGNKIDIPYAASEDELRYNMGLTNFTTGKGKVNLADSNVRPLEVFMCSIVRKMGYGEGFKWLSQYMQMDRLPRL

SEQ ID NO: 6592 - protein, 190 aa, Hordeum vulgare
MFLVDWFYGVLASLGLWQKEAKILFLGLDNAGKTTLLHMLKDERLVQHQPTQYPTSEELSIGQIKFKTFDLGGHQIARRVWKDYYAKVDAVVYLVDAADKERFAESKKELDGLLSDDSLANVPFLVLGNKIDIPIAASEEELRYYLGLSNFTTGKGNVNLSDSNVRPLEVFMCSIVRKMGYGEGFKWMSQ

SEQ ID NO: 6593 - protein, 193 aa, Citrus sinensis
MFLVDWFYGILVSLGLWQKEAKILFLGLDNSGKTTLLHMLKDERLVQHQPTQYPTSEELSIGKIKFKAFDLGGHQMARRVWKDYYAKVDAVVYLIDAYDKERFSESKRELDALLSDEALADVPFLILGNKIDIPYAASEDELRYHMGLTNFTTGKGNVNLDNTNVRPLEVFMCSIVRKMGYGKGFKWLSQYIK

SEQ ID NO: 6594 - protein, 184 aa, Nicotiana tabacum
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLASVPFLILGNKIDIPYAASEDELRYHMGLTGITTGKGKVNLAESNVRPLEVFMCSIVRKMGYGEG

SEQ ID NO: 6595 - protein, 197 aa, Beta vulgaris
MFLFDWFYGILASLGLWQKEAKILFLGLDNAGKTTLLHMLKDERLVQHQPTQHPTSEELSIGKIKFKAFDLGGHQIARRVWKDYYAKVDAVVYLVDAFDKERFAESKKELDALLSDEALANVPFLILGNKIDIPYAASEEELRFHLGLSNCTTGKGKVNLAGSNVRPLEVFMCSIVRKMGYGEGFKWVSNISTETRN

SEQ ID NO: 6596 - protein, 193 aa, Arabidopsis thaliana
MFLFDWFYGILASLGLCKKEAKILFLGLDNAGKTTLLHMLKDERLVQHQPTQHPTSEELSIGKINFKAFDLGGHQIARRVWKDCYAKVDAVVYLVDAYDRDRFVESKRELDALLSDEALANVPCLILGNKIDIPYASSEDELRYYLGLTNFTTGKGIVNLEDSGVRPLEVFMCSIVRKMGYGEGFKWLSQYIK

SEQ ID NO: 6597 - protein, 193 aa, Cryptomeria japonica
MFLFDWFYSILATLGLWQKEAKILFLGLDNAGKTTLLHMLKDERLVQHQPTQYPTSEELSIGKIKFKAFDLGGHQIARRVWKDYYAKVDAVIYLVDAADKERFAESKKELDALLSDDALTTVPFLILGNKIDIPYAASEEEIRYYLGLSNYTTGKGKVSLADSNVRPIEVFMCSIVRKMGYGEGLKWLEQYIK

SEQ ID NO: 6598 - protein, 193 aa, Cycas rumphii
  misc_feature (94)..(94): Xaa can be any naturally occurring amino acid
  misc_feature (106)..(106): Xaa can be any naturally occurring amino acid
MFLFDWFYSILATLGLWQKEAKILFLGLDNAGKTTLLHMLKDERLVQHQPTQYPTSEELSIGKIKFKAFDLGGHEMARRVWKDYYAKVDAVVYXVDAADKDRFAEXKKELDALLSDDSLANVPFLILGNKIDIPYAASEDELRYYLGLTNYTTGKGKVNLADSNVRPIEVFMCSIVRKMGYGEGIKWLSQYIK

SEQ ID NO: 6599 - protein, 193 aa, Pinus taeda
MFLFDWFYSVLATLGLWQKEAKILFLGLDNAGKTTLLHMLKDERLVQHQPTQYPTSEELSIGKIKFKAFDLGGHQIARRVWKDYYAKVDAVIYLVDAADKERFAEARKELDALLTDDSLTNVPFLILGNKIDIPYAASEEELRYYLGLANYTTGKGKVNLSDSNVRPIEVFMCSIVRKMGYGEGIKWLSQYIK

SEQ ID NO: 6600 - protein, 193 aa, Picea glauca
MFLFDWFYSILATLGLWQKEAKILFLGLDNAGKTTLLHMLKDERLVQHQPTQYPTSEELSIGQIKFKAFDLGGHQIARRVWKDYYAKVDAVVYLVDAADKERFAESRKELDALLTDDSLTNVPFLILGNKIDIPYAASEEELRYYLGLTNYTTGKGKVNLSDSNVRPIEVFMCSIVRKMGYGEGIKWLSQYIK

SEQ ID NO: 6601 - protein, 192 aa, Triphysaria pusilla
MFLLDWFYGVLASLGLYQKEAKILFLGLDNAGKTTLLHMLKDERLVQHQPTQHPTSEELSIGKIKFKAFDLGGHQIARRVWRDYYAKVDALVYLVDANDKERFAESKKELDALLSDDSLANVPFLILGNKIDLPYAASEDELRYYLGLTGLTTGKGKVELSSSNVRPIEVFMCSIVRKMGYGEGFRWMSQYI

SEQ ID NO: 6602 - protein, 193 aa, Orobanche aegyptiaca
MFILDWFYGILASLGLYQKEAKILFLGLDNAGKTTLLHMLKDERLVQHQPTQYPTSEELSIGKIKFKAFDLGGHQIARRVWRDYYAKVDAVVYLVDAYDKERFAESKKELDALLSDDSLANVPFLILGNKIDLPLAASEDELCYYMGLTGLTTGKGKVDLSNSNVRPLEVFMCSIVRKMGYGEGFRWMSQYIK

SEQ ID NO: 6603 - protein, 193 aa, Physcomitrella patens
MFLFDWFYSVLATLGLWQKEAKILFLGLDNAGKTTLLHMLKDERLAQHQPTQYPTSEELSIGKIKFKAFDLGGHQIARRVWKDYYAKVDGIVYLVDAADKERFSESKKELDALLSDDSLGQVPFLVLGNKIDIPYAASEDELRYSLGLSNYTTGKGKVNLGDSNIRPIEVFMCSIVRKMGYGEGIKWMSQYIK

SEQ ID NO: 6604 - protein, 193 aa, Raphanus sativus
  misc_feature (141)..(141): Xaa can be any naturally occurring amino acid
  misc_feature (145)..(145): Xaa can be any naturally occurring amino acid
  misc_feature (159)..(159): Xaa can be any naturally occurring amino acid
  misc_feature (183)..(183): Xaa can be any naturally occurring amino acid
MFLFDWFYGILATLGLWQKEAKILFLGLDNAGKTTLLHMLKDERLVQHQPTQHPTFEELSIGKIKFKAFDLGGHQIARRVWKDYYAMVDAVVYLVDAYDKERFVESKRELDALLSDEALASVPFLILGNKIDIPYAASEDXLRYXLGLTNFTTGKSNVXLEESGVRPLEVFMCSIVRKMGYGXGFKWLSYYIK

SEQ ID NO: 6605 - protein, 193 aa, Physcomitrella patens
MFLFDWFYSVLATLGLWQKEAKILFLGLDNAGKTTLLHMLKDERLAQHQPTQYPTSEELSIGKIKFKAFDLGGHQIARRVWKDYYAKVDGIVYLVDAADKERFSESKKELDALLSDDSLGQVPFLVLGNKIDIPYAVSEDELRYSLGLSNFTTGKGKVNLGDTNMRPIEVFMCSIVRKMGYGEGIKWMSQYIK

SEQ ID NO: 6606 - protein, 189 aa, Persea americana
MFLFDWIYGVLASLGLWQKESKILFLGLDNAGKTTLLHMLKDERLVQHQPTQYPTSEELSIGKIKFKAFDLGGHRIARRVWKDYYAKVDAVVYLVDAFDRDRFAESKKELDALLSDDSLANVPFLILGNKIDIPYAASEEQLRYHLGLTNFTTGKGKVSLMDSDVRPLEVFMCSIVRKMGYGDGFKWLS

SEQ ID NO: 6607 - protein, 182 aa, Zingiber officinale
  misc_feature (40)..(44): Xaa can be any naturally occurring amino acid
ASLGLWQKEAKILFLGLDNAGKTTLLHMLKDERLVQHQPXXXXXSEELSIGKIKFKAFDLGGHQIARRVWKDYYAKVDAVVYLVDAYDKERFAESKKELDALLSDDALANVPFLILGNKIDIPYAASEDELRYHLGLNNFTTGKGKVNLVDSNVRPLEIFMCSIVRKMGYGEGFKWVSQYIK

SEQ ID NO: 6608 - protein, 183 aa, Arachis hypogaea
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKRELDALLSDESLANVPFLILGNKIDIPYAASEEELRYNMGLSNFTTGKGNVNLADTGVRPLEVFMCSIVRKMGYGE

SEQ ID NO: 6609 - protein, 193 aa, Unknown
  Sequence found in Organisms: Solanum tuberosum, Solanum phureja
MFLVDWFYGVLASLGLWQKDAKILFLGLDNAGKTTLLHMLKDERLVQHQPTQYPTSEELSIGNIKFKAFDLGGHQIARRVWRDYYAKVDAVVYLVDANDRERFPEAKKELDGLLSDESLTNVPFLILGNKIDIPYAASEDELRYHLGLTGVTTGKGNVNLAGTNVRPIEVFMCSIVRKMGYGEGFKWMSQYIK

SEQ ID NO: 6610 - protein, 193 aa, Brassica oleracea
  misc_feature (14)..(14): Xaa can be any naturally occurring amino acid
  misc_feature (36)..(36): Xaa can be any naturally occurring amino acid
  misc_feature (127)..(127): Xaa can be any naturally occurring amino acid
  misc_feature (142)..(142): Xaa can be any naturally occurring amino acid
MFLFDWFYGILATXGLWQKEAKILFLGLDNAGKTTXLHMLKDERLVQHQPTQHPTSEELSIGKIKFKAFDLGGHQIARRVWKDYYAKVDAVVYLVDAYDKERFVESKRELDALLSDEALSSVPFLIXGNKIDIPYAASEDEXRYHLGLTDFTTGKSNVSLGESGVRPFEVFMCSIVRKMGYGEGFKWLSYYIK

SEQ ID NO: 6611 - protein, 193 aa, Marchantia polymorpha
MFLFDWFYSVLATLGLWQKEAKILFLGLDNAGKTTLLHMLKDERLAQHQPTQYPTSEELSIGKIKFKAFDLGGHQIARRVWKDYYAKVDGIVYLVDAADKERFAESKKELDALLSDDSLAQVPFLVLGNKIDIPYAASEDELRSHLGLTNYTTGKGKVNLGESHMRPIEVFMCSIVRKMGYGDGIKWMSQYIK

SEQ ID NO: 6612 - protein, 194 aa, Petunia hybrida
MFLVDWFYGVLASLGLWNKEAKILFLGLDNAGKTTLLHMLKDERLVQHQPTQYPTSEELSIGRIKFKAFDLGGHQIARRVWRDYYAKVDAVVYLVDAYDRERFPESKRELDGLLSDESLANVPFLILGNKIDIPYAVSEDELRYHLGLTGVTTGKGNVNLADSNVRPIEVFMCSIVKKMGYGDGFKWMSQYVKY

SEQ ID NO: 6613 - protein, 193 aa, Solanum lycopersicum
MFLVDWFYGVLASLGLWQKDAKILFLGLDNAGKTTLLHMLKDERLVQHQPTQYPTSEELSIGNIKFKAFDLGGHQIARRVWRDYYAKVDAVVYLVDANDRERFPEAKKELDGLLSDESLTNVPFLILGNKIDIPYAASEDELRYHLGLTGVTTGKGNINLAGTNVRPIEVFMCSIVRKMGYGEGFKWMSQYIK

SEQ ID NO: 6614 - protein, 185 aa, Gerbera hybrid cultivar
MASCSSRLWQKEAKILFLGLDNAGKTTLLHMLKDERLAQHQPTQHPTSEELSIGKIKFKAFDLGGHQIARRVWKDYYAKVDAVVYLVDAYDKERFAESKKELDALLSDENLSTVPFLILGNKIDIPYAASEDELRYHLGLTGVTTGKGKVNLQDSSVRPLEVFMCSIVRKMGYGDGFKWVSQYIK

SEQ ID NO: 6615 - protein, 181 aa, Brassica juncea
TLGLWQKEAKILFLGLDNAGKTTLLHMLKDERLVQHQPTQHPTSEELSIGKIKFKAFDLGGHQIARRVWKDYYAKVDAVVYLVDAYDKERFVESKRELDALLSDEALASVPFLILGNKIDIPYAASEDELRYHLGLTNFTTGKSNVSLGESGVRPLEVFMCSIVRKMGYGEGFKWLSYYIK

SEQ ID NO: 6616 - protein, 176 aa, Rhizophora mangle
QKEAKILFLGLDKAGKTTLLHMLKDERLVQHQPTQYPTSEELSIGKIKFKAFDLGGHQIARRVWKDYYAKVDAVVYLVDAYDKERFAESKKELDALLSDEALANVPFPVLGNKIDIPYAASEDELRYHLGLSNFTTGKGKVNLADSNVRPLEVFMCSIVRKMGYGDGFKWLSQYIK

SEQ ID NO: 6617 - protein, 177 aa, Brassica napus
WQKEAKILFLGLDNAGKTTLLHMLKDERLVQHQPTQHPTSEELSIGMIKFKAFDLGGHQIARRVWKDYYAKVDAVVYLVDAYDKERFAESKKELDALLSDEALANVPFLILGNKIDIPYAASEDELRYHLGLSSCTTGKGKVNLTDSNVRPLEIFMCSIVRKMGYGEGFKWVSQYIN

SEQ ID NO: 6618 - protein, 185 aa, Gossypium hirsutum
  misc_feature (75)..(75): Xaa can be any naturally occurring amino acid
  misc_feature (87)..(87): Xaa can be any naturally occurring amino acid
  misc_feature (149)..(149): Xaa can be any naturally occurring amino acid
  misc_feature (167)..(167): Xaa can be any naturally occurring amino acid
MFFLDWIYGILASLGLWQKEAKILFLGLDNAGKTTLLHMLKDERLVQHQPTQHPTSEELSIGKIKFKAFDLGGHXIARRVWKDYYAXVDAVVFLVDSYDKERFAESKRELDALLSDEALASVPFLILGNKIDIPYAASEDELRYHLGLXNFTTGKGKVNLGDSSVRXLEVFMCSIVRKMGYGDRF

SEQ ID NO: 6619 - protein, 69 aa, Ipomoea batatas
MFLLDWFYGVLASLGLWQKEAKILFLGLDNAGKTTLLHMLKDERLVQHQLHSVSYLRGVEYWQNQVQSF

SEQ ID NO: 6620 - protein, 182 aa, Acacia harpophylla
MFLVDWFYGILASLGLRQKEAKILFLGLDNAGKTTLLHMLKDERLVQHQPTQYPTSEELSIGKIKFKAFDLGGHQIARRVWKDYYAQVDAVVYLVDAYDKERFAESKRELDALLSDETLANVPFLILGNKIDLPYAASEDELRYHMGPTNFTTGKGKVNLADSNVRPLEVFMCSIARKMGYG

SEQ ID NO: 6621 - protein, 187 aa, Antirrhinum majus
  misc_feature (84)..(84): Xaa can be any naturally occurring amino acid
FYGILSSLGLYQKEAKILFLGLDNAGKTTLLHMLKDERLVQHQPTQYPTSEELSIGQIKFKAFDLGGHQIARRVWKDYYAKVDXVVYLVDAYDKERFAESKKELDALQSDESLANVPFLILGNKIDIPYSASEEELRYYMGLTGLTTGKGKVNLDGTNVRPLEVFMCSIVRKMGYGEGFRWVSQYIK

SEQ ID NO: 6622 - protein, 180 aa, Antirrhinum majus
MFLLDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALADVPFLILGNKIDIPYAASEDELRFHLGLTGVTIGKGKVDLADTNVRPLEVFMCSIVRKMG

SEQ ID NO: 6623 - protein, 176 aa, Petunia hybrida
MFLFDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDEALATVPFLILGNKIDIPYAASEDELRYHLGLTGLTTGKGKPNDSNVRPLEVYMCSIVRK

SEQ ID NO: 6624 - protein, 191 aa, Selaginella moellendorffii
MFLVDWFYGVLASLGLWQKEGKILFLGLDNAGKTTLLHMLKDERLVQHQPTQYPTSEELSIGKIKFKAFDLGGHQIARRVWKDYYAKVDGIVYLVDDADKERFPEAKKELDALLADDSLSQVPFLVLGNKIDIPYAASEEELRWFLGLSHTTGKGKADLSSNVRPIEVFMCSIVRKMGYGEGFRWLSQYIK

SEQ ID NO: 6625 - protein, 176 aa, Triticum aestivum
QKEAKILFLGLDNAGKTTLLHMLKDERLVQHQPTQYPTFEELSIGKIKFKAFDLGGHQIARRVWKDYYAKVDAVVYLVDAYDKERFAESKKELDALLSDDSLATVPFLILGNKIDIPYAASEEELRYHLGFSNFTTGKGKVSLSESNVRPLEVFMCSIVRKMGYGEGFKWMSQYIK

SEQ ID NO: 6626 - protein, 155 aa, Cyamopsis tetragonoloba
MLKDERLVQHQPTQYPTSEELSIGKIKFKAFDLGGHQIARRVWKDYYAQVDAVVYLVDAYDKERFAESKKELDALLSDESLANVPFLILGNKIDLPYAASEDELRYHLGLTNFTTGKGKVNLSDSNVRPMEVFMCSIVKKMGYGDGFRWVSQYIK

SEQ ID NO: 6627 - protein, 200 aa, Cichorium intybus
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDEYDRERFAESKNELDALLSDESLANVPFLILGNKIDLNYAASEDELRYHMGLTGLTTGKGKVNLENSGVRPLEVFMCSIVRKMGYGDGFKVGVSVYQVRRKVYE

SEQ ID NO: 6628 - protein, 192 aa, Adiantum capillus-veneris
MFLVDWFYNFLASLGIWQKEAKILFLGLDNAGKTTLLHMLKDARLAQHQPTQHPTSEELSIGKIKFKTFDLGGHQIARRVWKDYDAKVDGIVYLVDAADKERFPESKKELDGLLSDDSLAGVPFLILGNKIDIPTAASEEELRYYLGLSNFTTGKGKVTLAENMRAIEVFMCSIVRKMGYGEGFKWLSEYID

SEQ ID NO: 6629 - protein, 106 aa, Artemisia annua
MVFLQSWYCRVHSHFLVLVHLCVESPTKCGTVGIQGIAWAFGGMIFALVYCTAGISGGHINPAVTFGLLLARKLSCSVLEPSVVQVWSKGSKVKTNSPLWVVEPML

SEQ ID NO: 6630 - protein, 178 aa, Artemisia annua
LWQKEAKILFLGLDNAGKTTLLHMLKDERLVQHQPTQYPTSEELSIGQIKFKAFDLGGHQIARRVWKDYYAKVDAVVYLVDAYDKERFAESKKELDALLSDESLATVPFLILGNKIDIPYAASEEELSYHMGLQGSTTGKGKVNLENIGVRPLEVFMCSIVRKMGYGDGFKWVSQYIK

SEQ ID NO: 6631 - protein, 175 aa, Actinidia deliciosa
  misc_feature (143)..(143): Xaa can be any naturally occurring amino acid
  misc_feature (149)..(149): Xaa can be any naturally occurring amino acid
MFLLDWFYGVLASLGLWQKEAKILFLGLDNAGKTTLLHMLKDERLVQHQPTQYPTSEELSIGQIKFKAFDLGGHQIARRVWKDYYAKVDAVVYLVDAYDKERFAESKKELDALLSDESLATVPFLILGNKIDIPYAASEDELXYHMGLXGVTTGKGKVNLADSAVRPLEVFMCSI

SEQ ID NO: 6632 - protein, 175 aa, Petunia hybrida
MFLWDWFYGVLSSLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLATVPFLILGNKIDIPYAASEDELRYHLGLTGVTTGKGKANLADSGVRPLEVYMCSI

SEQ ID NO: 6633 - protein, 185 aa, Selaginella moellendorffii
FYGVLASLGLWQKEGKILFLGLDNAGKTTLLHMLKDERLVQHQPTQYPTSEELSIGKIKFKAFDLGGHQIARRVWKDYYAKVDGIVYLVDDADKERFPEAKKELDALLADDSLSQVPFLVLGNKIDIPYAASEEELRWFLGLSHTTGKGKADLNSNVRPIEVFMCSIVRKMGYGEGFRWLSQYIK

SEQ ID NO: 6634 - protein, 151 aa, Mesembryanthemum crystallinum
MLKDERLVQHQPTQYPTSEELSIGKIKFKAFDLGGHQIARRVWKDYYAKVDAVVYLVDAYDKERFAESKKELDALLSDEALATVPFLILGNTIDIPYAALEDELRYHFGLSIFTTGKGKVILADSNVRSMEVFTCSIVSTFYSVRSLSSLS

SEQ ID NO: 6635 - protein, 126 aa, Cicer arietinum
MFIFDWFYGILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKSSMPCSQMNPWQMFHFSF

SEQ ID NO: 6636 - protein, 192 aa, Physcomitrella patens
MFIVDWFYGFLASIGLWQKEAKILFLGLDNAGKTTLLHMLKDEKLGQHQPTQYPTSEELSINRVKFKAFDLGGHTIARRVWRDYYAKVDAIVYLVDAVDKERFPESKKELDSLLSDDSLSQVPVLVLGNKIDIPYAASEDELRYTLGLTMTTGKGTVNLKDSNIRPIEVFMCSIVRKMGYGEGFKWMTQYIK

SEQ ID NO: 6637 - protein, 192 aa, Mimulus guttatus
MFNFDWFYGLLSSLGLYRKEAKILFLGLDNAGKTTLLHMLRDEKLVQHQPTQHPTSEELSIGNINFKAFDLGGHRIARRVWSDYYAKVDAVLYLVDASDKERFAESKRELNALLSDESLRNAPFLILGNKIDLHYAASEDELRYHMGLTGVTTGKGKVNLADTNVRPIEVFMCSIVRKMGYGDGFRWVSQYI

SEQ ID NO: 6638 - protein, 171 aa, Arachis hypogaea
ILFLGLDNAGKTTLLHMLKDERLVQHQPTQHPTSEELSIGKIKFKAFDLGGHQVARRVWKDYYAKVDAVVYLVDAYDKERFAESKKELDALLSDEALANVPFLVLGNKIDIPYAASEEELRYHLGLTNFTTGKGKVNLTESNVRPLEVFMCSIVRKMGYGDGFKWVSQYIK

SEQ ID NO: 6639 - protein, 48 aa, Taraxacum officinale
MVMGLSGSLSTSSSELGLKNVGFRIYVCLKTGVFCFITEYISMSLIVG

SEQ ID NO: 6640 - protein, 170 aa, Cicer arietinum
LFLGLDNAGKTTLLHMLKDERLVQHQPTQYPTSEELSIGKIKFKAFDLGGHQIARRVWKDYYAQVDAVVYLVDAYDKERFAESKKELDALLSDESLANVPFLVLGNKIDIPYAASEEELRYHLGLSNFTTGKGKVNLSDSNVRPMEVFMCSIVKKMGYGDGFKWVSQYIK

SEQ ID NO: 6641 - protein, 192 aa, Physcomitrella patens
MFLVDWFYGFLASIGLWQKEAKILFLGLDNAGKTTLLHMLKDEKLGQHQPTQYPTSEELSINRVKFKAFDLGGHTIARRVWRDYYAKVDAIVYLVDAVDRERFAESKKELDSLLSDDSLSQVPVLVLGNKIDIPYASSEDELRFTLGLTMTTGKGTVNLGDSNIRPIEVFMCSIVRKMGYGEGFKWMTQYIK

SEQ ID NO: 6642 - protein, 192 aa, Selaginella moellendorffii
MFLFDWFYSVLATLGLWQKEAKILFLGLDNAGKTTLLHMLKDERLVQHQPTQYPTSEELSINKIKFKAFDLGGHQIARRVWKDYYAKVDGIVYIVDAADHERFPEAKKELDALLSDDSLAQVPFVILGNKIDLPYATSEQDLRYKLGLNNYTTGKGKVELGENMRPIEVFMCSVVRKMGYGEAFRWLSDYIK

SEQ ID NO: 6643 - protein, 215 aa, Ocimum basilicum
MFLLDWFYGVLASLGLWQKEGKILFLGLDNAGKTTLLHMLKDERLVQHQPTQHPTSEELSIGNIKFKAFDLGGHQIARRVWKDYYAKVDAVVYLVDAYDKERFAESKKELDALLSDDSLANVPFLILGNKIDIPYAASEDELSYHLGLTGITTGKGKVNLSDSNVRPIEVFMCSIVRKMGYGDGFKWGLSVYQVDTDNAFGFMGFRWSFRYSFCL

SEQ ID NO: 6644 - protein, 190 aa, Selaginella moellendorffii
MFLFDWFYSVLATLGLWQKEAKILFLGLDNAGKTTLLHMLKDERLVQHQPTQYPTSEELSINKIKFKAFDLGGHQIARRVWKDYYAKVDGIVYIVDAADHERFPEAKKELDALLSDDSLAQVPFVILGNKIDLPYAISEQDLRYKLGLNNYTTGKGKVELGENMRPIEVFMCSVVRKMGYGEAFRWLSDY

SEQ ID NO: 6645 - protein, 148 aa, Eragrostis curvula
MFLWDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDDSLANVPFLILGNKIDIPYAASAEELAHHLGP

SEQ ID NO: 6646 - protein, 166 aa, Zinnia violacea
ILASLGLWQKEAKILFLGLDNAGKTTLLHMLKDERLVQHQPTQHPTSEELSIGKIKFKAFDLGGHQIARRVWKDYYAKVDAVVYLVDAYDKERFAESKKELDALLSDENLSAVPFLILGNKIDIPYAASEDELRYHLGLTGVTTGKGKVNLQDSSVRPLEVFMCSI

SEQ ID NO: 6647 - protein, 223 aa, Hordeum vulgare
RHEASFCRCASRSVNRRPPPPPAAEKEATDGVRRPWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDDSLATVPFLILGNKIDIPYAASEEELRYHLGLSNFTTGKGKVSLSESNVRPLEVFMCSIVRKMGYGEGFKWMSQYIK

SEQ ID NO: 6648 - protein, 164 aa, Eschscholzia californica
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAFDKERFAESKKELDALLSDESLATVPFLILGNKIDIPYAASEDELRYHLGLTNFTTGKGKVNLADNQ

SEQ ID NO: 6649 - protein, 175 aa, Persea americana
  misc_feature (170)..(170): Xaa can be any naturally occurring amino acid
MFLFDWFYGILASLGLWQKEAKILFLGLDNAGKTTLLHMLKDERLVQHQPTQYPTSEELSIGKIKFKAFDLGGHRIARRVWKDYYAKVDAVVYLVDAFDKGRFAESKKELDALLSDDSLANVPFLILGNKIDIPYASSEEELLYYLGLTNFTTGKGKVSLAESDVRPLEXFMCSI

SEQ ID NO: 6650 - protein, 165 aa, Lolium multiflorum
DNAGKTTLLHMLKDERLVQHQPTQYPTSEELSIGKIKFKAFDLGGHQIARRVWKDYYAKVDAVVYLVDAYDKERFAESKKELDALLSDDSLATVPFLILGNKIDIPYAASEEELRYHMGLSNFTTGKGKVSLSESNVRPLEVFMCSIVRKMGYGDGFKWMSQYIK

SEQ ID NO: 6651 - protein, 213 aa, Lotus japonicus
MFLFDWFYGILASLGLWQKEAKILFLGLDNAGKTTLLHMLKDERLVQHQPTQHPTSEELSIGKIKFKAFDLGGHQVARRVWKDYYAKVDAVVYLVDAYDKERFAESKKELDALLSDEALASVPFLVLGNKIDIPYASSEDELRYHLGLTNFTTGKGKVNLTDSNLRPLEVFMCSIVRKMGYGERLPVAFPIYQVEFSFIFVPHSQVNYPCLQL

SEQ ID NO: 6652 - protein, 193 aa, Elaeis guineensis
MFLVEWLYGILAMLGLAAKEAKILFLGLDNAGKTTLLHMLKDERLAQHQPTQFPTSEELMIGKIKFTAFDLGGHRMARRVWRDYYAKVDAVVYIVDAADKERFLESKIELDALLGDETLANVPFLVLGNKIDIPYAASEDELRYHLGLANCTTGKGRIDYSNTNIRPIELFMCSIVRKMGYGDGFRWLSQYIK

SEQ ID NO: 6653 - protein, 61 aa, Cajanus cajan
MPGKTTLLHMLKDERLVQHQPTQHPTSEELSIGKIKFKAFDLGGHQVARRVWKDYYARWMR

SEQ ID NO: 6654 - protein, 96 aa, Lolium multiflorum
DNAGKTTLLHMLKDERLVQHQPTQYPTSEELSIGKIKFKAFDLGGHQIARRVWKDYYAKVDAVVYLVDAYDKRGLPNPRRSLMPSSQMIHWQPFPS

SEQ ID NO: 6655 - protein, 193 aa, Ostreococcus lucimarinus
MVFFFDWFYDVLASLGLWQKNAKILFLGLDNAGKTTLMHMLKDERLAQHQPTQYPTSEELSIGQIRFKAFDLGGHEVARRVWKDYYAKVDAIVFLVDAVDKERFMESKKELDSLLGDDSLGNVPFLILGNKIDIPHAASEEELRHCLGLTNYTTGKGKVNLENTNMRPIEVFMCSVVRRMGYAEGFRWVSQYI

SEQ ID NO: 6656 - protein, 165 aa, Ipomoea batatas
MFLVDWFYGILASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDESLANVPFLILGNKIDIPYAASEDELRYHMGLTGITTGKGKVNLADSNV

SEQ ID NO: 6657 - protein, 174 aa, Persea americana
MFLFDWFYGILASLGLWQKEAKILFLGLDNAGKTTLLHMLKDERLVQHQPTQYPTSEELSIGKIKFKAFDLGGHRIARRVWKDYYAKVDAVVYLVDAFDKGRFAESKKELDALLSDDSLANVPFLILGNKIDIPYASSEEELLYYLGLTNFTTGKGKVSLAESDVRPLEGFMCS

SEQ ID NO: 6658 - protein, 166 aa, Unknown
  Sequence found in Organisms: Brassica napus, Brassica oleracea
MALRMWASSTANALKLSSSTSKSHLLPAFSISRCFSSVLEGLKYANSHEWVKHDGSVATIGITDHAQDHLGEVVFVELPEEKSSVSKEKNFGAVESVKATSEILSPISGEVIEVNTKLTDSPGLINSSPYEDGWMIKVKPSNPAELETLMGPKEYTKFCEEEDAAH

SEQ ID NO: 6659 - protein, 166 aa, Brassica napus
  misc_feature (46)..(46): Xaa can be any naturally occurring amino acid
  misc_feature (70)..(70): Xaa can be any naturally occurring amino acid
MALRMWASSTANALKLSSSTSKSHLLPAFSISRCFSSVLEGLKYAXSHEWVKHDGSVATIGITDHAQDHXGEVVFVELPEEKSSVSKEKNFGAVESVKATSEILSPISGEVIEVNTKLTDSPGLINSSPYEDGWMIKVKPSNPAELETLMGSKEYTKFCEEEDAAH

SEQ ID NO: 6660 - protein, 165 aa, Cleome gynandra
MALRIWASSTAKALKLSSTSKTNLSPVFSISRCLSTVLEGLKYANSHEWVKHEGSVATIGITDHAQDHLGEVVFVELPDEKSTVNKDKPFGAVESVKATSEIISPISGEVIEINTKLNDSPGLINSSPYEDGWMIKVKPSSPLELESLMGSKEYTKFCEEEDAAH

SEQ ID NO: 6661 - protein, 165 aa, Persea americana
MSLRMWASSTANALRIACSTKAHLSPTFSLSRCFSSVLDGLKYTSSHEWVKHEGSVATVGITDHAQDHLGEVVFVELPESGLSVSKGGSFGAVESVKATSDINSPVSGEVIEVNTKLTESPGLINSSPYEEGWMIKVKPSSPSELEALMGSKEYTKFCEEEDAAH

SEQ ID NO: 6662 - protein, 628 aa, Brassica napus
MATKPGILTDWPWTPLGNFKYIVIAPWAVHSTYKFVTDDPVDLGYSLVLPFLLFRILHNQVWISLSRYYTTKGKRRILDKGIDFNQVDRETNWDDQILFNGLLFYIGIMLLPQAKQLPWWRTDGVLMAAMLHAGPVEFLYYWLHKALHHHFLYSRYHSHHHSSIVTEPITSVIHPFAEHIAYFILFAIPLLTTLLTKTGSIASFAGYVIYIDFMNNMGHCNFELVPKRLFHLFPPLKYLCYTPSFHSLHHTQFRTNYSLFMPLYDYIYGTMDETSHTLYEKSLERGEDRVDVVHLTHLTTPESIYHLRIGLASFASYPFSYRWFMRLLWPFTSLSMLFTLFYASLFVSERNSFEKLNLQSWIIPRYNLQYLLKWRKDAINNMIEKAILEANEKGVKVLSLGLMNQGEELNRNGEVYIHKHPEMKVRVVDGSRLTAAVVINSLPKSTTKIVMTGNLTKVAYTIASALCQRGVEVLTLLPEEYEKLSSFVPKECRDRLVLLTSETLASNKVWLMGEGTTREEQEMATKGTLFIPFSQFPLKKLRRDCIYHTPPALIIPKSLVNIHSCENWLPRKAMSATRVAGILHALEGWETHECGTSNILLSDLDQVWEACLSHGFQPLLLPHHFQYP

SEQ ID NO: 6663 - protein, 628 aa, Brassica napus
  misc_feature (199)..(199): Xaa can be any naturally occurring amino acid
MATKPGILTDWPWTPLGNFKYIVIAPWAVHSTYKFVTDDPVDLGYSLVLPFLLFRILHNQVWISLSRYYTTKGKRRILDKGIDFNQVDRETNWDDQILFNGLLFYIGIMLLPQAKQLPWWRTDGVLMAAMLHAGPVEFLYYWLHKALHHHFLYSRYHSHHHSSIVTEPITSVIHPFAEHIAYFILFAIPLLTTLLTKTXSIASFSGYVIYIDFMNNMGHCNFELVPKRLFHLFPPLKYLCYTPSFHSLHHTQFRTNYSLFMPLYDYIYGTMDETSHTLYEKSLERGEDRVDVVHLTHLTTPESIYHLRIGLASFASYPFSYRWFMRLLWPFTSLSMLFTLFYASLFVSERNSFEKLNLQSWIIPRYNLQYLLKWRKDAINNMIEKAILEANEKGVKVLSLGLMNQGEELNRNGEVYIHKHPEMKVRVVDGSRLTAAVVINSLPKSTTKIVMTGNLTKVAYTIASALCQRGVEVLTLLPEEYEKLSSFVPKECRDRLVLLTSETLASNKVWLMGEGTTREEQEMATKGTLFIPFSQFPLKKLRRDCIYHTPPALIIPKSLVNIHSCENWLPRKAMSATRVAGILHALEGWETHECGTSNILLSDLDQVWEACLSHGFQPLLLPHHFQYP

SEQ ID NO: 6664 - protein, 256 aa, Brassica napus
MLSLVASPPVISAASLSKPLQSLSKAALSLSKRAKPTSPFPKTARSISVYKSPMNNLFTRLGFGSRPQPDPASAAIAQGPDDDVPSPGQQFAQFGAGCFWGAELAYQRVPGVTKTEVGYSHGFVDNPSYEDVCSETTGHNEIVRVQYDPKEVSFESLLDVFWKRHDPTTLNRQGNDVGTRYRSGIYFYTDEQEKLAREAMEKQQKILNRKIVTEILPATKFYRAENYHQQYLAKGGRMGLSQSAEKGCNDPIRCYG

SEQ ID NO: 6665 - protein, 256 aa, Brassica napus
MLSIVASPPVISAVSLSKPLQSLAKAALSLSKRAKPTSPFPKTARSISVYKSPMNNLFTRLGFGSRPQPDPASSAIAQGPDDDVPSPGQQFAQFGAGCFWGAELAYQRVPGVTKTEVGYSHGFVDNPTYEDVCSETTGHNEIVRVQYDPKEVSFESLLDVFWKRHDPTTLNRQGNDVGTRYRSGIYFYTDEQEKLAREAMEKQQKILNRKIVTEILPATKFYRAENYHQQYLAKGGRMGLSQSAEKGCNDPIRCYG

SEQ ID NO: 6666 - protein, 266 aa, Brassica rapa
HVTLSPFPSIMLSLVASPPVISAASLSKPLQSLSKAALSLSKRAKPTSPFPKTARSISVYKSPMNNLFTRLGFGSRPQPDPASAAIAQGPDDDVPSPGQQFAQFGAGCFWGAELAYQRVPGVTKTEVGYSHGFVDNPSYEDVCSETTGHNEIVRVQYDPQEVSFESLLDVFWKRHDPTTLNRQGNDVGTRYRSGIYFYTDEQEKLAREAMEKQQKNLNRKIVTEILPATKFYRAENYHQQYLAKGGRMGLSQSAEKGCNDPIRCYG

SEQ ID NO: 6667 - protein, 264 aa, Brassica napus
TLSPFPSIMLSLVASPPVISAASLSKPLQSLSKAALSLSKRAKPTSPFPKTARSISVYKSPMNNLFTRLGFGSRPQPDPASAAIAQGPDDDVPSPGQQFAQFGAGCFWGAELAYQRVPGVTKTEVGYSHGFVDNPSYEDVCSETTGHNEIVRVQYDPKEVSFESLLDVFWKRHDPTTLNRQGNDVGTRYRSGIYFYTDEQEKLAREAMEKQQKILNRKIVTEILPATKFYRAENYHQQYLAKGGRMGLSQSAEKGCNDPIRCYG

SEQ ID NO: 6668 - protein, 246 aa, Brassica oleracea
ISAVSLSKPLQSLAKAALSLSKRAKPTSPFPKTARSISVYKSPMNNLFTRLGFGSRPQPDPASSAIAQGPDDDVPSPGQQFAQFGAGCFWGAELAYQRVPGVTKTEVGYSHGFVDNPTYEDVCSETTGHNEIVRVQYDPKEVSFESLLDVFWKRHDPTTLNRQGNDVGTRYRSGIYFYTDEQEKLAREAMEKQQKILNRKIVTEILPATKFYRAENYHQQYLAKGGRMGLSQSAEKGCNDPIRCYG

SEQ ID NO: 6669 - protein, 268 aa, Brassica napus
PRVRTLSPVPSIMLSIVASPPVISAVSLSKPLQSLAKAALSLSKRAKPTSPFPKTARSISVYKSPMNNLFTRLGFGSRPQPDPASSAIAQGPDDDVPSPGQQFAQFGAGCFWGAELAYQRVPGVTKTEVGYSHGFVDNPTYEDVCSETTGHNEIVRVQYDPKEVSFESLLDVFWKRHDPTTLNRQGNDVGTRYRSGIYFYTDEQEKLAREAMEKQQKILNRKIVTEILPATKFYRAENYHQQYLAKGGRMGLSQSAEKGCNDPIRCYG

SEQ ID NO: 6670 - protein, 262 aa, Raphanus sativus
  misc_feature (255)..(255): Xaa can be any naturally occurring amino acid
DVTLSIMLSLVASPPVISAASLSKPLRSLSKSALPLSRRARPIFPFPKTARSITVYKSPMNSLFNRLGFGSRPQPDPASAAIAQGPDDDVPSSGQQFAQFGAGCFWGAELAYQRVPGVTKTEVGYSQGFVDGPSYDDVCSETTGHNEIVRVQFDPKEVSFESLLDVFWKRHDPTTLNRQGNDVGTRYRSGIYVYTDEQEKLARESMENQQKVLNRKIVTEILPATKFYRAESYHQQYLAKGGRMGLRQSAEKGCXDPIRCYG

SEQ ID NO: 6671 - protein, 255 aa, Thellungiella halophila
MLALAASPPVISAASLSKPLHSLSKAALPLSRAKPICPFPKTSRPISVYKPPMNNLFNRLGFGSRPQPDPSSAAIAQGPDDDVPSPGQQFAQFGAGCFWGVELAYQRVPGVTRTEVGYSHGLVHNPSYEDVCTGTTGHNEVVRVQYDPKECSFENLLDVFWKRHDPTTLNRQGNDVGTQYRSGIYYYTDEQEKLAREAVEKQEKILNKKIVTEILPAKKFYRAENYHQQYLAKGGRMGLRQSAEKGCNDPIRCYG

SEQ ID NO: 6672 - protein, 257 aa, Arabidopsis lyrata
MQVIVASPPLISAASLSKPLHSLSKAALSFSRAKPLCPFPQTSRPISVYKSPMNNLFNRLGFGSRPQAQVDPTSAAIAQGPDDDVPSPGQQFAQFGAGCFWGVELAYQRVPGVTKTEVGYSHGLMHNPSYEDVCTGTTGHNEVVRVQYDPKECSFETLLDVFWNRHDPTTLNRQGGDVGTQYRSGIYYYTDEQERIAREAVEKQQKILNKKIVTEILPATKFYRAENYHQQYLAKGGRMGLRQSAEKGCKDPIRCYG

SEQ ID NO: 6673 - protein, 258 aa, Arabidopsis thaliana
MQVLVVSPPLIAAASLSKPLNSLSKAALSFSRAKPICPFPQTSRRPISVYKSPMNNLFNRLGFGSRPQAQADPSSAAIAQGPDDDVPSSGQQFAQFGAGCFWGVELAYQRVPGVTKTEVGYSHGIVHNPSYEDVCTGTTGHNEVVRVQYDPKECSFESLLDVFWNRHDPTTLNRQGGDVGTQYRSGIYYYTDEQERIAREAVEKQQKILNKRIVTEILPATKFYRAENYHQQYLAKGGRMGLRQSAEKGCKDPIRCYG

SEQ ID NO: 6674 - protein, 253 aa, Brassica napus
MPAPVASSPVISAASLSKPLHSLSKAAHPLFKPVCPFPKTARSISIYKPPMNNLFNRLGYGSRSQQDPSSAAIAEGPDDDVPSPGQQFAQFGAGCFWGLELAYQRVPGVTRTEVGYSHGFVHDPIYEDVCTGMTGHNEVVRVQYDPKECSFEHLLDVFWNRHDPTTLNRQGNDVGTQYRSGIYYYTDEQEKLARESLEKQEKILNKKIVTEILPAKKFYRAEEYHQQYLAKGGSMGRRQSAEKGCNDPIRCYG

SEQ ID NO: 6675 - protein, 253 aa, Raphanus sativus
MLALITSPPVISAASLSKPLHSLSKAVLPLVKPICPFPKTARSVSIYKPPMNNLFNRLGYGSTSQLDPSSAAIAEGPDDDVPSPGQQFAQFGAGCFWGLELAYQRVPGVTKTEVGYSHGFVHNPIYEDVCTGMTGHNEVVRVQYDPKECSFENLLDVFWKRHDPTTLNRQGNDVGTQYRSGIYYYTEEQEKLARESLEKQEKILNKKIVTEILPAKKFYRAEEYHQQYLGKGGSMGRRQSAEKGCNDPIRCYG

SEQ ID NO: 6676 - protein, 253 aa, Brassica napus
  misc_feature (4)..(4): Xaa can be any naturally occurring amino acid
  misc_feature (18)..(18): Xaa can be any naturally occurring amino acid
  misc_feature (21)..(21): Xaa can be any naturally occurring amino acid
  misc_feature (35)..(35): Xaa can be any naturally occurring amino acid
  misc_feature (46)..(46): Xaa can be any naturally occurring amino acid
  misc_feature (75)..(75): Xaa can be any naturally occurring amino acid
  misc_feature (192)..(192): Xaa can be any naturally occurring amino acid
  misc_feature (208)..(208): Xaa can be any naturally occurring amino acid
  misc_feature (241)..(241): Xaa can be any naturally occurring amino acid
  misc_feature (246)..(246): Xaa can be any naturally occurring amino acid
MPAXVASSPVISAASLSXPLXSLSKAAHPLFKPVXPFPKTARSISXYKPPMNNLFNRLGYGSRSQQDPSSAAIAXGPDDDVPSPGQQFAQFGAGCFWGLELAYQRVPGVTRTEVGYSHGFVHDPIYEDVCTGMTGHNEVVRVQYDPKECSFEHLLDVFWNRHDPTTLNRQGNDVGTQYRSGIYYYTDEQEKXARESLEKQEKILNKKXVTEILPAKKFYRAEEYHQQYLAKGGSMGRRQSXEKGCXDPIRCYG

SEQ ID NO: 6677 - protein, 170 aa, Unknown
  Sequence found in Organisms: Brassica napus, Brassica rapa
MARFTVLIAAVILAFVVAVPEVTAKKYTVGENKFWNPNINYTIWAQGKHFYLGDWLYFVFDRNQHNILEVNKTDYENCNADHPLVNWTRGAGRDIVTLNVTKHYYLLDGKGGCYGGMKLAVKVEKLPPPPKAAPVKSIGSVSMATGVAQFVIPFALFSVSTVWDAILRMW

SEQ ID NO: 6678 - protein, 170 aa, Brassica nigra
MARFTVLIAAAVLAFVVAVPDVTAKKYTVGENKFWNPNINYTIWAQGKHFYLGDWLYFVFDRNQHNILEVNKTDYENCNADHPLVNWTRGAGRDIVALNVTKHYYLLDGKGGCYGGMKLAVKVEKLPPPPKAAPVKSIGSVSMATGVAQFVIPFALFSVSTVWDAILRMW

SEQ ID NO: 6679 - protein, 170 aa, Unknown
  Sequence found in Organisms: Brassica napus, Brassica oleracea
MARFTVLIAAVILAFVVAVPEVTAKKYTVGENKFWNPNINYTIWAQGKHFYLGDWLYFVFDRNQHNILEVNKTDYENCNADHPLVNWTRGAGRDIVTLNVTKHYYLLDGKGGCYGGMKLAVKVEKLPPPPKAAPVKSTGLVSMATGVAQFVIPFALFSVSTMRDAILRMW

SEQ ID NO: 6680 - protein, 162 aa, Brassica napus
MARLTVLIAAVILAFLVAMPVPEVTAKKYTVGDNKFWNPNINYTIWAQGKHFYLGDWLYFVFDRNQHNILEVNKTDYENCNSDHPLVNWTRGAGRDVVPLNVTKHYYLLDGKGGCYGGMKLAVKVEKLPPPPKSAPVKNIGSVSVVTGLAQFMIPFALLRMW

SEQ ID NO: 6681 - protein, 162 aa, Brassica napus
  misc_feature (24)..(24): Xaa can be any naturally occurring amino acid
  misc_feature (36)..(36): Xaa can be any naturally occurring amino acid
MARLTVLIAAVILAFLVAMPVPEXTAKKYTVGDNKXWNPNINYTIWAQGKHFYLGDWLYFVFDRNQHNILEVNKTDYENCNSDHPLVNWTRGAGRDVVPLNVTKHYYLLDGKGGCYGGMKLAVKVEKLPPPPKSAPVKNIGSVSVVTGLAQFMIPFALLRMW

SEQ ID NO: 6682 - protein, 162 aa, Brassica napus
MARLTVLIAAVILAFLVAMPVPEVTAKKYTVGDNKFWNPNINYTIWAQGKHFYLGDWLYFVFDRNQHNILEVNKTDYENCNSDHPLVNWTRGAGRDVVPLNVTKHYYLLDGKGGCYGGMKLAVKVEKLPPPPKAAPVKNVGSVSVVTGLVQLIVPLALLRMW

SEQ ID NO: 6683 - protein, 367 aa, Brassica napus
MSQLYSSMKPTPMLKDELDIVIPTIRNLDFLEMWRPFFEQYHLIIVQDGDPSRTINIPKGFDYELYNRNDINRILGPKSSCISFKDSACRCFGYMVSKKKYIYTIDDDCFVAKDPSGKDINALEQHIKNLLSPSTPHFFNTLYDPYGDGADFVRGYPFSMREGAITAVSHGLWLNIPDYDAPTQLVKPLERNFRYVDGVMTIPKGTLFPMCGMNLAFDRELIGPAMYFGLMGDGQPIGRYDDMWAGWCVKVIYDHMGWGVKTGLPYIWHSKASNPFVNLRKEYNGIFWQEEAIPFFQSVTLPKECDSVQQCYIELAKLVKEKLGKVDPYFIKLADGMVTWIEAWEELNAPKGTEANAPNAKDEKVTE

SEQ ID NO: 6684 - protein, 367 aa, Brassica napus
MSQLYSSMKPTPMLKDELDIVIPTIRNLDFLEMWRPFFEQYHLIIVQDGDPSRTINIPKGFDYELYNRNDINRILGPKSSCISFKDSACRCFGYMVSKKKYIYTIDDDCFVAKDPSGKDINALEQHIKNLLSPSTPHFFNTLYDPYGDGADFVRGYPFSMREGAITAVSHGLWLNIPDYDAPTQLVKPLERNFRYVDAVMTIPKGTLFPMCGMNLAFDRELIGPAMYFGLMGDGQPIGRYDDMWAGWCVKVIYDHMGWGVKTGLPYIWHSKASNPFVNLRKEYNGIFWQEEAIPFFQSVTLPKECDSVQQCYIELAKLVKEKLGKVDPYFIKLADGMVTWIEAWEELNAPKGTEANAPNAKDEKVTE

SEQ ID NO: 6685 - protein, 378 aa, Arabidopsis lyrata
MAQLYSSVKPTPMLKDELDIVIPTIRNLDFLQMWRPFFEQYHLIIVQDGDPSKVINIPEGFDYELYNRNDINRILGPKASCISFKDSACRCFGYMVSKKKYIYTIDDDCFVAKDPTGKEINALEQHIKNLLSPSTPHFFNTLYDPYRDGADFVRGYPFSMRKGAITAVSHGLWLNIPDYDAPTQLVKPLEKNSRKFDLPLRLPILYVDAVMTIPKGTLFPMCGMNLAFDRELIGPAMYFGLMGDGQPIGRYDDMWAGWCVKVICDHMGWGVKTGLPYIWHSKASNPFVNLKKEYNGIFWQEEAIPFFQSVTLPKECTSVQQCYLELAKLVKEKLGKVDPYFITLATGMVTWIEAWEELNSEERTEAKAPNGNKEKVTE

SEQ ID NO: 6686 - protein, 170 aa, Arabidopsis lyrata
MDQILNKVGSYWLGKKANKQLDSVGDDINSLSTSIEGGTKWLVNKIKGKMQKPLPELLKEFGLPVGIFPRDATNYEFNEQTRKLTVFIPSICEVGYKDSSVLRFTTTVTGFLEKGKLADVEGMKTKVMIWVKVTSISADSSKVHFTAGMKKIRSRDAYEVLRDGVEIDKF

SEQ ID NO: 6687 - protein, 170 aa, Raphanus sativus
MDQILNKVGSYWLGKKANKQLDSVGDDINSLSTSIEGGTKWLVNKIKGKMQKPLPELLKEFGLPVGIFPRDATNYEFNEQTRKLTVFIPTVCEVGYKDSSVLRFTTTVTGFLEKGKLADVEGMKTKVMIWVKVTSVSADSSKVHFTAGMKKSRSRDAYEVLRDGVEIDKF

SEQ ID NO: 6688 - protein, 170 aa, Arabidopsis thaliana
MDQILNKVGSYWLGKKANKQLDSVGDDINSLSSSIEGGTKWLVNKIKGKMQKPLPELLKEFGLPVGIFPRDATNYEFNEQTRKLTVFIPSICEVGYKDTSVLRFTTTVTGFLEKGKLADVEGMKTKVMIWVKVTSISADSSKVHFTAGMKKSRSRDAYEVLRDGVEIDKF

SEQ ID NO: 6689 - protein, 170 aa, Brassica oleracea
  misc_feature (22)..(22): Xaa can be any naturally occurring amino acid
  misc_feature (35)..(35): Xaa can be any naturally occurring amino acid
MDQILNKVGSYWLGKKANKQLXSVGDDINSLSTSXEGGTKWLVNKIKGKMQKPLPELLKEFGLPVGIFPRDATNYEFNEQTRKLTVFIPTICEVGYKDSSVLRFTTTVTGFLEKGKLADVEGMKTKVMIWVKVTSISADSSKVHLTAGMKKSRSRDAYEVLRDGVEIDKF

SEQ ID NO: 6690 - protein, 170 aa, Thellungiella halophila
MDQILNKVGSYWLGKKANKQLDSVGDDINSLSTSIEGGTKWLVNKIKGKMQKPLPELLKEFGLPVGIFPRDATNYEFNEQTRKLTVFIPSVCEVGYKDSSVLRFTTTVTGFLEKGKLADVEGVKTKVMIWVKVTSISADSSKVHFTAGMKKTRSRDAYEVLRDGVEIDKF

SEQ ID NO: 6691 - protein, 170 aa, Cleome spinosa
MDQILNKVGSYWIGQKANKQLDSVGDDINSLSTSIEGGAKWLVNKIKGKMQKPLAELLKEYGLPVGIFPRDATNYEFNEQTGKLTVFIPTMCEVGYKDSSVLRFNTTVTGYLEKGKVGEVEGMKTKVMIWVKVTCISADSSKVHFTAGMKKSRSRDAYEVLRDGVEVLKF

SEQ ID NO: 6692 - protein, 170 aa, Raphanus sativus
MDQMFNKVGSYWLGHKANKQFDSVGDDINSISTSIEGGTKWLVNKIKGTMQKPLPELLKEYDLPVGIFPRDATNYEFDEQTKKLTVLIPSVCEVGYKDSSVLKFTTTVTGYLEKGKLCDVEGMKTKVMIWVKVTSISADSSKVYFTAGMKKSRNRDAYEVLRDGVRVDKF

SEQ ID NO: 6693 - protein, 170 aa, Tropaeolum majus
MDQILNKVGSYWLGKKANKQLDSVGDDFNSLSTSIEGGAKWLVNKIKGKMQKPLPDLLKEFDLPIGIFPRDATNYEFNEETGKLIVFVPSICEVGYKDSSVLRFSTTVSGYLEKGKLADVEGMKTKVMIWVKVTCITADASKVHFTAGMKKSRSKVAYNVLRDGVSVDKF

SEQ ID NO: 6694 - protein, 170 aa, Cleome gynandra
MDQILNKVGSYWIGKKANKQLDSVGDDINSLSTSIEGGAKWLVNKIKGKMQKPLVDLLKEYELPVGMFPRDATNYEFNEETKKLIVYIPKICEVGYKDSSVLRFNTTVSGYLEKGKLVDVEGMKTKVMIWVKVTCVSSDSSKVHFTAGMKKSRSRDAYEALRDGVEVSKF

SEQ ID NO: 6695 - protein, 170 aa, Arabidopsis thaliana
MDQILNKVGSYWLGQKANKEFNSVGDDFNSLSSSIEGGTKWLVNKLKGKMQKPLPELLKEFGLPVGIFPQDATNYEFNEETGKLTVFIPETCEVGYRDSSVLRFSTTVTGYLEKGKLAEVEGMKTKVMIWVKVTCISADSSKVYFTAGIKKSRSRDAYEVIRPGVGVDKF

SEQ ID NO: 6696 - protein, 170 aa, Carica papaya
MDQILNKVGSYWIGQKANKEIGSVGDDINSLSTSIEGGAKWLVNKIKGKMQKALPELLSEYGLPVGIFPRDATNYEFNEETGKLTVFIPSICEVGYKDSSVLRFSTAVTGYLEKGKLADIEGMKTKVVIWVKVSSISADASKVHFSAGMKRSRSRDAYEVLRDGVSVDKF

SEQ ID NO: 6697 - protein, 170 aa, Raphanus sativus
MDQILNKVGSYWLGQKANKEFNSVGDDFNSLSSSIEGGTKWLVNKLKGKMQKPLPELLKEFGLPVGIFPQDATNYEFNEETGKLTVFIPETCEVGYRDSSVLRFSTTVTGYLEKGKLAEVEGLKTKVMIWVKVTCISADPSKVYFTAGMKKSRSRDAYEVIRPGVIVDKF

SEQ ID NO: 6698 - protein, 170 aa, Brassica napus
MDQILNKVGSYWLGQKANKEFNSVGDDFNSLSSSIEGGTKWLVNKLKGKMQKPLPELLKEFGLPVGIFPQDATNYEFNEETGKLTVFIPETCEVGYRDSSVLRFSTTVTGYLEKGKLAEVEGLKTKLMIWVKVTCISADPSKVYFTAGMKKSRSRDAYEVIRSGVSVDKF

SEQ ID NO: 6699 - protein, 170 aa, Arabidopsis lyrata
MDQIFNKVGSYWLGQKANKQFDSVGNDLNSVSTSIEGGTKWLVNKIKGKMQKPLPELLKEYDLPVGIFPGDATNYEFDEETKKLTVLIPSICEVGYKDSSVLKFTTTVTGHVEKGKLTDVEGIKTKVMIWVKVTSISADASKVYFTAGMKKSRSRDAYEVQRNGLRVDKF

SEQ ID NO: 6700 - protein, 170 aa, Brassica napus
MDQIMNKVGSYWLGQKANKEFNSVGDDFNSLSSSIEGGTKWLVNKLKGKMQKPLAELLKEFGLPVGIFPQDATNYEFNEETGKLTVFIPEACEVGYKDSSVLRFSTTVTGYLEKGKLAEVEGLKTKVMIWVKVSCISADVSKVYFTAGMKKSRSRDAYEVIRSGVSVDKF

SEQ ID NO: 6701 - protein, 170 aa, Brassica napus
MDQIMNKVGSYWLGQKANKEFNSVGDDFNSLSSSIEGGTKWLVNKLKGKMQKPLPELLKEFGLPVGIFPQDATNYEFNEETGKLTVFIPETCEVGYRDSSVLRFSTTVTGYLEKGKLAEVEGLKTKLMIWVKVTCISADPSKVYFTAGMKKSRSRDAYEVIRCGVSVDKF

SEQ ID NO: 6702 - protein, 170 aa, Eucalyptus gunnii
MDQVLNKVGTYWFSKKANKEINSVGDDINSMSSSIEGGAKWLVNKIKGKMQKPLPELLKEYDLPVGIFPRDATNYEFNEETGKLTVFIPTICEVGYKDSSVLRFFTTVTGYLEKGKLADIEGMKTKVMIWVKVTVISAEGSKLHLTAGMKKTRSRDAYEALRDGVIVDKF

SEQ ID NO: 6703 - protein, 170 aa, Raphanus sativus
MDQIMNKVGSYWLGQKANKEFNSVGDDFNSLSSSIEGGTKWLVNKLKGKMQKPLPELLKEFGLPVGIFPQDATNYEFNEETGKLTVFIPEACEVGYRDSSVLRFSTTVTGYLEKGKLAEVEGLKTKVMIWVKVSCISADASKVYFTAGMKKSRSRDAYEVIRPGVTVDKF

SEQ ID NO: 6704 - protein, 170 aa, Arabidopsis lyrata
MDQILNKVGSYWLGQKANKEFNSVGDDFNSLSSSIEGGTKWLVNKLKGKMQKPLPDLLKEFGLPVGIFPQDATNYEFNEDTGKLTVFIPETCEVGYRDSSVLRFSTTVTGYLEKGKLAEVEGLKTKVMIWVKVTCISADTSKVYFTAGIKKSRNRDAYEVIRPGVGVDKF

SEQ ID NO: 6705 - protein, 170 aa, Arabidopsis thaliana
MDQIFNKVGSYWLGQKANKQFDSVGNDLNSVSTSIEGGTKWLVNKIKGKMQKPLPELLKEYDLPIGIFPGDATNYEFDEETKKLTVLIPSICEVGYKDSSVLKFTTTVTGHLEKGKLTDVEGIKTKVMIWVKVTSISTDASKVYFTAGMKKSRSRDAYEVQRNGLRVDKF

SEQ ID NO: 6706 - protein, 170 aa, Brassica oleracea
MDQILNKVGSYCLGQKANKEFNSVGDDFNSLSSSIEGGTKWLVNKLKGKMQKPLPELLKEFGLPVGIFPQDATNYEFNEETGKLTVFIPETCEVGYRDSSVLRFSTTVTGYLEKGKLAEVEGLKTKLMIWVKVTCISADPSKVYFTAGMKKSRSRDAYEVIRSGFSVDKF

SEQ ID NO: 6707 - protein, 170 aa, Brassica napus
MDQVFNKVGSYWLGQKANKQFDSVGKDVSSLSTSIEGGTKWLVNKFKGTMQKPLAELLKDYDLPVGIFPRDATNYEFDEQTKKLTVLIPSVCEVGYKDSSVLKFTTTVTGRLEKGKLGDLEGMKTKVMIWVKVTSISADSSKVYFTAGVKKSRNRDAYEVLRDGVRADKF

SEQ ID NO: 6708 - protein, 170 aa, Gossypium hirsutum
MDQILNKVGSYWLGQKANKEIDSVGDDLNSLSTSIEGGAKWLVNKIKGKMQKPLPELLREYNLPIGIFPRDATNYEFNEETGKLTVFIPAICEVGYKDSSVLRFFTTVTGYLEKGKLADIEGMKTKVMIWVKVTSITCEGSKIYVTAGMKKSRNREAYEVSRDGVSVDKF

SEQ ID NO: 6709 - protein, 170 aa, Ipomoea nil
MDQILNKVGSYWIGKRANKEINSVGDDINSLSTSIEGGAKWLVNKIKGKMQKPLTELLKEYDLPVGIFPSDATNYEFNEETRKITVFIPSICEVGYKDSSVLRFATTVTGYLEKGKLADIEGMKTKVMIWVKVTAISSEKSKLHFSAGMKKTRNRDAYEVIRSGVNVDKF

SEQ ID NO: 6710 - protein, 170 aa, Manihot esculenta
MDQILNKVGSYWLGQKASKEFNSVGDDINSLSSSIEGGTKWLVNKIKGKMQKSLPELLKEYDLAIGIFPRDATNYEFNEETGKLTVFIPSICEVGYKDSSVLRFFTAVTGYLEKGKLADISGMKTKVMIWVKVTCITSDGSKLHFTAGMKKTRSREAYEVLRDGVSVDKF

SEQ ID NO: 6711 - protein, 170 aa, Orobanche aegyptiaca
MDQILNKVGSYWLGQKANKEFNSVGDDINSLSTSIEGGAKWLVNKLKGKMQKPLPELLKEYDLPVGIFPRDATNYEFNEETRKLTVYIPSVCEVGYKDSSVLRFSTTVTGYLEKGKLVDIEGIKTKMIVWVKVTCISSEKSKLNFTAGMKKSRSRDAYEVLRDGIGVDKF

SEQ ID NO: 6712 - protein, 170 aa, Theobroma cacao
MDQILNKVGSYWLGQKANKEINSVGDDINSLSTSIEGGAKWLVNKIKGKMQKPLQELLKEYNLPIGIFPRDATNYEFNEETGKLTVFIPTVCEVGFKDSSVLRFFTTVTAYLEKGKLADIEGMKTKVVIWVKVTSITSDGSKLYVTAGMKKSRNREAYEVSRDGVSVDKF

SEQ ID NO: 6713 - protein, 170 aa, Coffea canephora
MDQILNKVGSYWLGQKANKEFSSVGDDINSMSSSIEGGAKWLVNKIKGKMQKPLPELLKEYDIAVGIFPRDATNYEFNEETRKLTVFIPSVCEVGYKDSSVLRFSTVVTGYLEKGKFVDIEGMKTKVLIWVKVTAIATEGSKLHFTAGMKKTRSRDAYEVLRDGVGIDKF

SEQ ID NO: 6714 - protein, 170 aa, Liriodendron tulipifera
MDQILNKVGTYWFSKKANKEINSVGDDINSMSSSIEGGAKWLVNKLKGKMQKPLPELLQDYGLAIGIFPRDATNYEFNEETRKLTVFIPSICEVGYKDSSVLRFATIVTGYLEKGKLADIEGLKTKVMIWVKVTSISTEGSKIHFMAGMKKSRSRDAYEVLRDGVGVDKF

SEQ ID NO: 6715 - protein, 170 aa, Triphysaria pusilla
MDQILNKVGSYWLGQKANKEFNSVGDDINSLSTSIEGGTKWLVNKLKGKMQKPLPELLKEYDLPVGIFPRDATNYEFNEETRKLIVYIPSVCEVGYKDSSVLRFATTVTGYLEKGKLVEVEGIKTKVIVWVKVTCISSEKSKLCFTAGMKKSRSRDAYDVLRDGICVDKF

SEQ ID NO: 6716 - protein, 171 aa, Cleome gynandra
MDQILNKVGSYWLGRKANKELNSVGDDFNSLSSGIEGGTKWLVNKIKGKMQKPLPELLKEYGLPIGIFPRDTTNYEFNEETGKLRVFIPEISEVGYKDSSVLRFMTTVTGYLEKGKLMEIEGMKTKVVMIWVKVTFISADAFKVHFTAGVKKSKNRDAYEVLRVAVAVDKF

SEQ ID NO: 6717 - protein, 170 aa, Linum usitatissimum
MDQIFNKVGSYWFNQKANKEINSVGDDINSLSDSIGGGAKWVVNKIKGKMQKPLPDLLKEYDLPVGIFPRDATNYEFNEETHKLTVFIPQICDVGYKDSSVLRFNTQVTGYLEKGKLTDVEGMKTKVMIWVKVTSITSEGSKVHFTAGMKKSRSRDAYEVLRDGLHVEKF

SEQ ID NO: 6718 - protein, 170 aa, Manihot esculenta
  misc_feature (42)..(42): Xaa can be any naturally occurring amino acid
  misc_feature (53)..(53): Xaa can be any naturally occurring amino acid
  misc_feature (157)..(157): Xaa can be any naturally occurring amino acid
MDQILNKVGSYWLGQKASKEFNSVGDDINSLSSSIEGGTKWXVNKIKGKMQKXLPELLKEYDLAIGIFPRDATNYEFNEETGKLTVFIPSICEVGYKDSSVLRFFTAVTGYLEKGKLADISGMKTKVMIWVKVTCITSDGSKLHFTAGMKKTRSREXYEVLRDGVSVDKF

SEQ ID NO: 6719 - protein, 170 aa, Vitis vinifera
MDQILNKVGSYWFSQKANKEIDSVGDDINSLSTSIEGGAKWLVNKLKGKMQKPLPELLKEYNLAVGIFPRDATNYEFNEETKKLTVFIPSVCEVGYRDSSVLRFSTIVTGYLEKGKLADIEGMKTKVVIWVKVTAISAEGSKLYFTAGMKKSRSRGVYEVVRDGVCVDKF

SEQ ID NO: 6720 - protein, 170 aa, Populus trichocarpa
MDAVLNKVGSYWLGQKASKEFNSVGDDINSLSTSIEGGTKWLVNKLKGKMQKPLPDLLKEYDLPIGIFPRDATNYEFNEETRKLTVFIPSICEVGYKDSSVVRFLTTVTGYLEKGKIADIEGMKTKVMIWVKVTCIASTGSKLNFTAGMKKTRDRGAYEVLRDGVGIDKF

SEQ ID NO: 6721 - protein, 170 aa, Populus trichocarpa
MDAVLNKVGSYWLGQKASKEFNSVGDDINSLSTSIEGGTKWLVNKLKGKMQKPLPDLLKEYDLPIGIFPRDATNYEFNEETRKLTVFIPSICEVGYKDSSVVRFSTTVTGYLEKGKIADIEGMKTKVMIWVKVTCIASTGSKLNFTAGMKKTRDRGAYEVLRDGVGIDKF

SEQ ID NO: 6722 - protein, 170 aa, Triphysaria pusilla
  misc_feature (18)..(18): Xaa can be any naturally occurring amino acid
MDQILNKVGSYWLGQKAXKEFNSVGDDINSLSTSIEGGTKWLVNKLKGKMQKPLPELLKEYDLPVGIFPRDATNYEFNEETRKLIVYIPSVCEVGYKDSSVLRFATTVTGYLEKGKLVEVEGIKTKVIVWVKVTCISSEKSKLCFTAGMKKSRSRDAYDVLRDGICVDKF

SEQ ID NO: 6723 - protein, 170 aa, Salvia sclarea
MDQILNKVGSYWLGQKANKEINSVGDDINSLGSSIEGGAKWLVNKLKGKMQKPLPELLKEYDLPVGIFPRDATNYEFNEETRKLIVYIPAVCEVGYKDSSVLRFSTMVTGYLEKGKLVDIEGIKTKVIVWVKVTCISSEKSKVSFTAGVKKSRSRDAYEVLRDGVGIEKF

SEQ ID NO: 6724 - protein, 170 aa, Actinidia deliciosa
  misc_feature (165)..(165): Xaa can be any naturally occurring amino acid
  misc_feature (170)..(170): Xaa can be any naturally occurring amino acid
MDQILNKVGSYWIGQKANKEMSSVGDDINSMSTSIQGGASWLVNKIKGKMQKPLPELLKDYDLAVGIFPRDATNYEFNEETGKLTVYIPSICEVGYKDSSVLRFSTTVTGYLEKGKLADIDGMKTKVMIWVKVSCISADGGKLHFTAGMKKTRSRDAYEVLRDGXSVDKX

SEQ ID NO: 6725 - protein, 170 aa, Capsicum annuum
MDQILNKVGSYWIGKRANKELNSVGDDINSLQSSIEGGTKWLVNKLKGKMQKPLPDLLKEYDVPVGIFPRDATNYEFNEETRKLTVYIPSVCEVGYKDSSILRFSTAVTGYLEKGKLVDIEGMKTKVMVWVKVTAISSEKSKVHFTAGLKKTRSREAYEVLRDGVAIEKF

SEQ ID NO: 6726 - protein, 170 aa, Nicotiana tabacum
MDQILNKVGSYWIGKRANKELNSVGDDINSLQSSIEGGTKWLVNKLKGKMQKPLPDLLKEYDVPIGIFPRDATNYEFNEETRKLTVYIPSVCEVGYKDSSVLRFSTAVTGYLEKGKLADIEGMKTKVMMWVKVTAISSEKSKIHFTAGLKKTRSREAYEVLRDGVAIEKF

SEQ ID NO: 6727 - protein, 170 aa, Solanum lycopersicum
MDQILNKVGSYWIGKRANKEINSVGDDINSLQSSIEGGTKWLVNKLKGKMQKPLPDLLKEYDVPVGIFPRDATNYEFNEETRKLTVFIPSVCEVGYKDSSVLRFSTAVTGYLEKGKLVEIEGMKTKVMVWVKVTAISSEKSKVHFTAGLKKTRSREAYEVLRDGVAIEKF

SEQ ID NO: 6728 - protein, 170 aa, Juglans hindsii x Juglans regia
MDQVLNKVGSYWFSKRANKEINSVGDDFNSLSTSIEGGTKWLVNKIKGKMQKPLPELLKEYDMAVGIFPRDATNYEFNEETRKLTVYIPAICEVGYRDSSVLRFSTTITGYLEKGKLVDIEGMKTKVMIWVKVTCISSDGSKLHFTAGMKKTRSREAYEYLRDGIIVDKF

SEQ ID NO: 6729 - protein, 160 aa, Ipomoea batatas
MDQVLNKVGSYWIGKRANKEINSVGDDINSLSTSIEGGAKWLVNKIKGKMQKPLTELLKEYDLPVGIFPRDATNYEFNEETRKLTVYIPSICEVGYKDSSVLRFATTVTGYLEKGKLADIEGMKTKVMIWVKVTAISSEKSKLHFSAGMGCNQEQRCLRG

SEQ ID NO: 6730 - protein, 170 aa, Ricinus communis
MDQILNKVGSYWLGQKANKELNSVGDDINSLSSSIEGGAKWLVNKMKGKMQKPLPELLKEYDLAIGIFPRDATNYEFNAETGKLTVFVPEICEVGYKDSSVLRFFTTITGYLEKGKLADIEGIKTKVLIWVKVTCITSDGPKLHFTAGMKKTRKREAYEVLRDGVSVDKF

SEQ ID NO: 6731 - protein, 170 aa, Castanea mollissima
MDQILNKVGSYWFSQKAHKEINSVGDDINSLSTSIEGGTKWLVNKLKGKMQKPLPELLKEYDMAVGIFPRDATNYEFTEATGKLIVYIPAVCEVGYKDSSVLRFSTIVSGYLEKGKLTDIEGMKTKVMIWVKVTAVSSDGSKLHFTAGMKKSRSREAYEVLRDGVTIDKF

SEQ ID NO: 6732 - protein, 170 aa, Arachis hypogaea
MDQILNKVGSYWFNRKATKQLDSVGDDINSLSDSIGGGTRWLVNKIKGKMQKPLTELLKEYDLPVGIFPRDTTNYEFNEETRKLVVYIPQVCEVGYKDSSVLRFTTTVTCYLEKGKLADIEGMKTKVLIWTKVTAISSEGSKLHFTAGMKKTRSREAYEVSRDGVTVEKF

SEQ ID NO: 6733 - protein, 164 aa, Heritiera littoralis
MDQILNKVGSYWLSQKANKEINSVGDDINSLSTSIDGGAKWLVNKIKGKMQKSLPELLKEYNLPIGIFPRDATNYEFNEETGKLTVFIPTICEVGYKDSSVLRFFSTVTGYLEKGKLADIEGMKTKVMIWVKVTTITSDGSKLYVSAGMKKTRNKRLMRSLGMV

SEQ ID NO: 6734 - protein, 170 aa, Ocimum basilicum
MDQILNKVGSYWLGQKANKEINSVGDDINSLSNSIEGGAKWLVNKLKGKMQKPLPELLKEYDLAIGIFPRDATNYEFNEETRKLTVFIPSVCEVGYKDSSVLRFSTTVTGYLEKGKLADIEGIKTKVIVWVKVTCISSEKSKLNFTAGVKKSRSRQAYEVQRDGICVEKF

SEQ ID NO: 6735 - protein, 170 aa, Solanum melongena
MDQILNKVGSYWIGQRANKEFNSVGDDIDSLQSSIEGGSKWIVNKIKGKMQKPLPELLKEHDVPVGIFPRDATNYEFNEETRKLTVYIPSICEVGYRDSSVLRFSTAVTGYLEKGKLADIEGMKTKVMIWVKVTSISSEKSKLYITAGLKKSRSREAYEVLRDGFTVDKF

SEQ ID NO: 6736 - protein, 170 aa, Quercus alba
MDQILNKVGSYWFSQRANKEINSVGDDINSLSTSIEGGTKWLVNKLKGKMQKPLPELLKEYDMAVGIFPRDATNYEFTEATGKLIVYIPAVCEVGYKDSSVLRFSTIVSGYLEKGKLTDIDGIKTKVMIWVKVTAISSDGSKLHFTAGMKKSRSREAYEVLRDGVTIDKF

SEQ ID NO: 6737 - protein, 170 aa, Rhizophora mangle
MDQVLNKVGSYWLGKRASKEFNSVGDDINSMSSSIEGGAKWLVSKIKGKMQKPLPELLKEYDLPVGIFPRDATNYEFNEETGKLTVFIPSICEVGYRDSSVLRFTNAVTGYLEKGKLVDIEGMKTKVMIWVKVTCITSDGPKLHLTAGMKKTRNRGAYEVLRDGVSVDKF

SEQ ID NO: 6738 - protein, 170 aa, Populus trichocarpa
MDAILNKVGSYWVGQKASKEFNSVGDDINSLSTSIEGGTKWLVNKLKGKMQKPLPDLLKEYDLPIGIFPRDATNYEFNEETRKLTVFIPSICEVGYKDSSVVRFSTTVTAFLEQGKLADIEGMKTKVMIWVKVSCIVSAGSKLNFTAGMKRTRDRGAYEVLRDGVGVDKF

SEQ ID NO: 6739 - protein, 170 aa, Unknown
  Sequence found in Organisms: Solanum tuberosum, Solanum phureja
MDQILNKVGSYWIGKRANKEINSVGDDINSLQSNIEGGTKWLVNKLKGKMQKPLSDLLKEYDVPVGIFPRDATNYEFNEETRKLTVFIPSVCEVGYKDSSVLRFSTAVTGYLEKGKLVEIEGMKTKVMVWVKVTAISSEKSKVHFTAGLKKTRSREAYEVLRDGVAIEKF

SEQ ID NO: 6740 - protein, 170 aa, Camellia sinensis
MDQILNKVGSYWIGQKANNEVDSVGDDINSLSTSIEGGAKWLVNKLKGKMQKPLPELLKEYDMAVGIFPRDATNYEFNEETGKLIVYIPSICEVGYRDKSVLRLSTTVTGYLEKGKLSDIEGMKTKVMIWVKVTCISADGGKLHFTAGMKKTRPRDAYEILRDGFSVDKF

SEQ ID NO: 6741 - protein, 170 aa, Nicotiana tabacum
MDQILNKLGSYWIGQKANKEINSVGDDINSLQSSIEGGSKWLVNKIKGKMQKPLPELLKEYDLPVGIFPRDATNYEFNEETKKLTVYIPSVCEVGYRDSSVLRFSTAVTGYLEKGKLADIEGMKTKVMMWVKVTAISSEKSKLHFTAGLKKTRSKEAYEVLRDGVAVDKF

SEQ ID NO: 6742 - protein, 170 aa, Nicotiana tabacum
MDQILNKLGSYWIGQKANKEFNSVGDDINSLQSSIEGGSKWLVNKIKGKMQKPLPELLKEYDLPVGIFPRDATNYEFNEETKKLTVYIPSVCEVGYRDSSVLRFSTAVTGYLEKGKLADIEGMKTKVMMWVKVMAISSEKSKLHFTAGLKKTRSREAYEVLRDGVAVDKF

SEQ ID NO: 6743 - protein, 170 aa, Solanum lycopersicum
MDQILNKVGSYWIGQKANKEINSVGDDINSLQSSIEGGSKWLVNKLKGKMQKPLPELLKEHDIPVGIFPRDATNYEFNEETRKLTVYIPSICEVGYRDSSVLRFSTAVTGYLEKGKLADIEGIKTKVMIWVKVTAISSEKSKLYVTAGLKKSRSREAYEVLRDGFTVDKF

SEQ ID NO: 6744 - protein, 170 aa, Solanum melongena
MDQILNKVGSYWIGKRANKEINSVGDDINSMQSSIEGGTKWLVNKLKGKLQKPLPDLLKEYDVPVGIFPRDATNYEFNEETRKLTVFIPSVCEVGYKDSSVLRFSTAVTGYLEKGKLVEIEGMKTKVMVWVKVTAISSEKSKVHFTAGLKKTRSREAYEVLRDGVAVEKF

SEQ ID NO: 6745 - protein, 173 aa, Persea americana
MDQVLNKVGTYWFSRRANKEINSVGDDINSLSSSIDSGAKWLVNKIKGKMQKPLPELLQEYDLAIGIFPRDATNYEFNEETKKLTVFIPSICEVGYRDSSVLRFATSVTGYLEKGKLTDVEGLKTKVMIWVKVTCISTEGSKIHFTAGMKKTRSRDAYEVLRDGVSIDKFQVS

SEQ ID NO: 6746 - protein, 170 aa, Medicago truncatula
MDQVLNKVGSYWFSKKANKELNSVGDDINSLSSSIEGGTKWLVNKLKGKMQKPLTELLKEYDLPIGIFPRDATNYEFNEETRKLVVYIPQVCEVGYRDSSVLRFTTTVSGYLEKGKLADIEGMKTKVLVWVKVTAISSEGPKLNFTAGMKKTRKREAYEVSRDGVIIDKF

SEQ ID NO: 6747 - protein, 170 aa, Juglans hindsii x Juglans regia
MDQILNKMGSYWFSQKANKEINSVGDDINSLSTSIEGGAKWLVNKVKGKMQKPLPELLKEYDMAVGIFPRDATNYEFNEEIGKLTVFVPAVCEVGYKDSSVLRFSTTITGYLEKGKLVDIEGMKTKVMIWVKVTCISSDGSKLHVTAGMKKTRSREAYEVLRDGVTVEKF

SEQ ID NO: 6748 - protein, 258 aa, Zea mays
MATTATEAAPAQEQQANGNGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIAEEKNHGSFDFVFVDADKDNYLNYHERLLKLVKLGGLIGYDNTLWNGSVVLPDDAPMRKYIRFYRDFVLVLNKALAADDRVEICQLPVGDGVTLCRRVK

SEQ ID NO: 6749 - protein, 186 aa, Triticum aestivum
MATTATEAAPAQEQQANGNGEQKTRHSEVGHKSLLKSDDLYQYILDTSVYPREPESMKELREITAKHPWNLMTTSADEGQFLNMLIKLIGAKKTMEIGVYTGYSLLATALALPEDGRSWHGHQPRELQLGLPCIEKAASPTRSTSARVPRSPSSTTSSRRRRTTGRSTSSSWTPTRTTTSTTTSGC

SEQ ID NO: 6750 - protein, 263 aa, Zea mays
MATTATEAAKAAPAQEQQANGNGNGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCINKAGVGHKIDFREGPALPVLDDLVADKEQHGSFDFAFVDADKDNYLSYHERLLKLVRPGGLIGYDNTLWNGSVVLPDDAPMRKYIRFYRDFVLALNSALAADDRVEICQLPVGDGVTLCRRVK

SEQ ID NO: 6751 - protein, 242 aa, Saccharum officinarum
MATTATEAAKAAPAEQANGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPVLDDLIADEKNHGSFDFVFVDADKDNYLNYHERLLKLVKLGGLIGYDNTLWNGSVVLPDDAPMRKYIRFYRDFVLVLNKALAADERVEIC

SEQ ID NO: 6752 - protein, 259 aa, Pennisetum glaucum
MATTAAEAAKAVEQPAAEQQQANGNGEQKTRHSEVGHKSLLKSDDLYQYILDTSVYPREPESMKELREVTAKHPWNLMTTSADEGQFLNMLIKLIGAKKTMEIGVYTGYSREDGTILAMDINRENYELGLPCIEKAGVAHKIDFREGPALPVLDDLIADEKNHGSFDFVFVDADKDNYLNYHERLLKLVKLHRLRQHAVERLRCAPRRRPHAQVHPLLPRLRRSPPTSASRSASSPSATVSPSAAASSEHVPPHTRLQS

SEQ ID NO: 6753 - protein, 260 aa, Oryza sativa
MAEAASAAAAATTEQANGSSGGEQKTRHSEVGHKSLLKSDDLYQYILETSVYPREHECMKELREVTANHPWNLMTTSADEGQFLNLLLKLIGAKKTMEIGVYTGYSLLATALAIPDDGTILAMDINRENYELGLPSIEKAGVAHKIDFREGPALPVLDQLVEEEGNHGSFDFVFVDADKDNYLNYHERLMKLVKVGGLVGYDNTLWNGSVVLPADAPMRKYIRYYRDFVLELNKALAADHRVEICQLPVGDGITLCRRVK

SEQ ID NO: 6754 - protein, 214 aa, Saccharum officinarum
MATTATEAAKAAPAEQANGEQKTRHSEVGHKSLLKSDDLYQYILDTSVYPREPESMKELREITAKHPWNLMTTSADEGQFLNMLIKLIGAKKTMEIGVYTGYSLLATALALPEDGTILAMDINRENYELGLPCIEKAGVAHKIDFREGPALPILDDLIADEKNHGSFVFVDADKDNYLNYHERLLKLVKLGGLIGYDNTLWNGSVVLPDDAPMR

SEQ ID NO: 6755 - protein, 394 aa, Arabidopsis lyrata
MRNMMNSAAAMRAVKEEFIVMDFDDNDEDVRCGKVKEEYMMDAEQINSSTDSGKTNPSNMQQIVSAVASDDDDDDDDDWGTKIDNQYMKLLDSFREDGSSNLSDNPLRSIRYEVDNGGYDKREFKANKRSREDRNTIRVTKKNVEPKPPHVQAGFRLRRRESLVSEKSVEAMLITSHVKRNSKHSFDASEKENLEDLMVLDEGYRSYLTWLVENSKSSRTNPEKERQVKCEEDYTVSLSDSDSDIIVVGDRPFLGEEDSPFVPSKSYKVVDLDEESSDQRNSWFRKEIMNVLKQPYTVTELKELHNEASVHRVSSRHVELRDGTEFSFPTKKKTPSYLDGYPDFKKQYLESLREDDEHKALNLLRGFIFYLTKVVRDDAFKPWLDQECLKIRCF

SEQ ID NO: 6756 - protein, 167 aa, Arabidopsis lyrata
MATKEPESVYEISIEDAKGNSLELSQYKDKVLLIVNVASKCGMTNSNYTELNELYSKYKDKGLEILAFPCNQFGDEEPGTSDQITDFVCTRFKSEFPIFNKIEVNGDNASPLYKFLKKGKWGIFGDDIQWNFAKFLVDKNGQAVERYYPTTSPITLEHDIKKLLNIS

SEQ ID NO: 6757 - protein, 167 aa, Raphanus sativus
MATKDPESVYDISIEDANGNSLELSQYKDKVLLIVNVASKCGMTNSNYTELNELYNKYKDKGLEILAFPCNQFGGEEPGTTAQITEFVCTRFKSEFPIFNKIEVNGENASPLYKFLKKGKWGIFGDEIQWNFAKFLVDKNGQAVERYYPTTSPLTLEHDIKKLLNLS

SEQ ID NO: 6758 - protein, 167 aa, Raphanus sativus
MATKDPESVYDISIEDANGNSLELSQYKDKVLLIVNVASKCGMTNSNYTELNELYNKYKDKGLEILAFPCNQFGEEEPGTTAQITEFVCTRFKSEFPIFNKIEVNGENASPLYKFLKKGKWGIFGDEIQWNFAKFLVDKNGQAVERYYPTTSPLTLEHDIKKLLNLS

SEQ ID NO: 6759 - protein, 167 aa, Thellungiella halophila
MATKGPESVYEITIEDAKGDSFELSQYKGKVLLIVNVASKCGMTNSNYTELNELYNKYKDKGLEILAFPCNQFGEEEPGTTDQITDFVCTRFKSEFPIFNKIEVNGENASPLYKFLKKGKWGIFGDDIQWDFAKFLVDKTGQAVERYYPTTSPLTLEHDIKKLLNIS

SEQ ID NO: 6760 - protein, 166 aa, Brassica napus
MATKEPVSVYDISIEDANGNSLELSQYKDKVLLIVNVASKCGMTNSNYTELNELYNKYKDKGLEILAFPCNQFGEEEPGTTDQITEFVCTKFKSEFPIFNKIEVNGENASPLYKFLKKGKWGIFGDEIQWNFAKFLVDKNGQAVERYYPTTSPLTLEHDIKKLLNV

SEQ ID NO: 6761 - protein, 167 aa, Brassica napus
MATKDPESVYDISIEDANGNSLELSQYKDKVLLIVNVASKCGMTNSNYTELNEIYNKYKDKGLEILAFPCNQFGEEEPGTTDQITEFVCTKFKSEFPIFNKIEVNGGNASPLYKFLKKGKWGIFGDDIQWNFAKFLVDKNGQAVERYYPTTSPLTLEHDIKKLLNVS

SEQ ID NO: 6762 - protein, 166 aa, Brassica oleracea
MATKEPVSVYDISIEDANGNSLELSQYKDKVLLIVNVASKCGMTNSNYTELNELYNKYKDKGLEILAFPCNQFGEEEPGTTDQITEFVCTKFKSEFPIFNKIEVNGENASPLYKFLKKGKWGIFGDEIQWNFAKFLVDKNGQAVERYYPTTSPLTLEHDINKLLNV

SEQ ID NO: 6763 - protein, 151 aa, Brassica rapa
DANGNSLELSQYKDKVLLIVNVASKCGMTNSNYTELNELYNKYKDKGLEILAFPCNQFGEEEPGTTDQITEFVCTKFKSEFPIFNKIEVNGENASPLYKFLKKGKWGIFGDEIQWNFAKFLVDKNGQAVERYYPTTSPLTLEHDIKKLLNV

SEQ ID NO: 6764 - protein, 171 aa, Cleome spinosa
MASVEGAKDPESVYAIIVKDAKGNSVDLSNYRGKVLLIVNVASKCGMTNSNYTELNELHNKYKDKGLEILAFPCNQFGEEEPGTNNEITEFVCTRFHSEFPIFEKIEVNGENASPLYKFLKKGKWEIFGDDIQWNFAKFLVDKNGQAVERYYPTTSPLSLERDIRKLLGMS

SEQ ID NO: 6765 - protein, 173 aa, Heritiera littoralis
MASQTTKNPESIYDFTVKDAKGNDVDLSACKGKVLLIVNVASKCGMTNSNYTELNQLYEKYKDQGLEILAFPCNQFGDEEPGSNDQIADFVCTRFKSEFPIFDKIEVNGDNASPLYKYLKLGKWGIFGDDIQWNFAKFLVSKDGQAVHRYYPTTSPLSLEYDIEKLLGISQNE

SEQ ID NO: 6766 - protein, 170 aa, Populus trichocarpa
MATQTSKNPESVHDFTIKDAKENDVDLSIFKGKVLLIVNVASKCGMTNSNYAEMNQLYEKYKDQGLEILAFPCNQFGEEEPGTNDQITDFVCTRFKSEFPIFDKIDVNGENASPLYKFLKLGKWGIFGDDIQWNFAKFLVNKDGQVVDRYYPTTSPLSLERDIKQLLEIS

SEQ ID NO: 6767 - protein, 197 aa, Arabidopsis lyrata
MAPPKNVDGEGKGKGKAIANTSTRVLRSMVRKTRSDTQREGSSSKLVKLESPEKKKRKTTKAKSGGAAKKKVKKEEVAVKIEKEDEESAEEEDDDAAEKEEEEEDDDDSEKKKIVIEHCKQCKSFRERANEVKEGLEEAVPGIIVTVNPDKPRRGCFEIREEGGETFISLLGMKRPFTPMKELNMEEVITDIVEKIK

SEQ ID NO: 6768 - protein, 206 aa, Arabidopsis lyrata
MPRSSRWVNHRATSKTKKLILFLLVAFVFYLYRYPSSPSTVEQSSSSIYNVSVKDIEGKDVSLSKFTGKVLLIVNVASKCGLTHGNYKEMNILYAKYKTQGFEILAFPCNQFGSQEPGSNKEIKETVCNIFKAEFPIFDKIEVNGKNTCPLYNFLKEQKGGLFGDAIKWNFAKFLVDRQGNVVDRYAPTTSPLEIEKDIVKLLASA

SEQ ID NO: 6769 - protein, 196 aa, Thellungiella halophila
MPKSSTWVSIFFLPLAFVFYLYRYPYSPAIVEHSSSSIYDISVKDIEGNDVSLSQFTGKVLLIVNVASKCGLTHGNYKELNILYAKYKAKGFEILAFPCNQFGSQEPGSNEEIKKTVCTMFKAEFPVFDKIEVNGENAAPLYKFLKEQKGGLFGDSIKWNFAKFLVDKQGNVVDRYAPTTSPLEIEKDIEKLLASA

SEQ ID NO: 6770 - protein, 544 aa, Arabidopsis lyrata
MQPYGIQSMLKEGYRHLSGLDEAVIKNIEACKELSTITRTSLGPNGMNKMVINHLDKLFVTNDAATIVNELEIQHPAAKLLVLAAKAQQEEIGDGANLTISFAGELLQNAEELIRMGLHPSEIISGYTKAVNKAVEILEQLVESGSETMDVRNKDEVISRMRAAVASKQFGQEEIICSLVADACIQVCPKNPTNFNVDNVRVAKLLGGGLHNSCIVRGMVLKSDAVGSIKRMEKAKVAVFAGGVDTTATETKGTVLIHSAEQLENYAKTEEAKVEELIKAVAESGAKVIVSGGSIGEMALHFCERYKIMVLKISSKFELRRFCRTAGAVAHLKLSRPSPDDLGYVDSISVEEIGGVTVTIARNEEGGNSISTVVLRGSTDSILDDLERAVDDGVNTYKAMCRDSRIVPGAAATEIELAQRLKEYANAEIGLDKYAISKYAESFEFVPKTLADNAGLNAMEIIAALYTGHGSGNTKLGIDLEEGACKDVSETKVWDLFATKLFALRYASDAACTVLRVDQIIMAKPAGGPRRDAAQAAGAGAEED

SEQ ID NO: 6771 - protein, 544 aa, Brassica napus
MQPYGIQSMLKEGYRHLSGLDEAVIKNIEACKELSTITRTSLGPNGMNKMVINHLDKLFVTNDAATIVNELEIQHPAAKILVLAAKAQQEEIGDGANLTISFAGELLQNAEELIRMGLHPSEIISGYNKAIIKVVEILEQLVESGSETMDVRDKDEVVSRMRAAVASKQFGQEEIICSLVADACIQVCPKNPTNFNVDNVRVAKLLGGGLHNSCIVRGMVLRSDAVGSIKRMEKAKVAVFAGGVDTTATETKGTVLIHSAEQLENYAKTEEAKVEELIKAVAESGAKVIVSGGSVGEMALHFCERYKIMVLKISSKFELRRFCRAAGAVAHLKLSRPSPDDLGYVDSISVEEIGGVTVTIARNEQGGNSISTVVLRGSTDSILDDLERAVDDGVNTYKAMCRDSRIVPGAAATEIELAQRLKEYANAETGLDKYAITKYAESFEFVPKTLADNAGLNAMEIIASLYTGHGSGNTKLGIDLEEGACKDVSETKVWDLFATKLFALKYASDAACTVLRVDQIIMAKQAGGPRRDAAQAAGAGAEED

SEQ ID NO: 6772 - protein, 544 aa, Brassica rapa
  misc_feature (280)..(280): Xaa can be any naturally occurring amino acid
MQPYGIQSMLKEGYRHLSGLDEAVIKNIEACKELSTITRTSLGPNGMNKMVINHLDKLFVTNDAATIVNELEIQHPAAKILVLAAKAQQEEIGDGANLTISFAGELLQNAEELIRMGLHPSEIICGYNKAIIKVVEVLEQLVESGSETMDVRSKDEVVSRMRAAVASKQFGQEEIICSLVADACIQVCPKNPTNFNVDNVRVAKLLGGGLHNSCIVRGMVLKSDAVGSIKRMEKAKVAVFAGGVDTTATETKGTVLIHSAEQLENYAKTEEAKVEELIKXVAESGAKVIVSGGSVGEMALHFCERYKIMVLKISSKFELRRFCRAAGAVAHLKLSRPSPDDLGYVDSISVEEIGGVTVTIARNEQGGNSISTVVLRGSTDSILDDLERAVDDGVNTYKAMCRDSRIVPGAAATEIELAQRLKEYANAETGLDKYAITKYAESFEFVPKTLADNAGLNAMEIIASLYTGHGSGNTKLGIDLEEGACKDVSETKVWDLFATKLFALKYASDAACTVLRVDQIIMAKQAGGPRRDAAQAAGAGAEED

SEQ ID NO: 6773 - protein, 548 aa, Brassica napus
MTMSMQPYGIQSMLKEGYRHLSGLDEAVIKNIEACKELSTITRTSLGPNGMNKMVINHLDKLFVTNDAATIVNELEIQHPAAKILVLAAKAQQEEIGDGANLTISFAGELLQNAEELIRMGLHPSEIICGYNKAIIKVVEVLEDLVESGSETMDVRNKDEVVSRMRAAVASKQFGQEEIICSLVADACIQVCPKNPTNFNVDNVRVAKLWGGGLHNSCIVRGMVLKSDAVGSIKRMEKAKVAVFAGGVDTTATETKGTVLIHSAEQLENYAKTEEAKVEELIKAVAESGAKVIVSGGSVGEMALHFCERYKIMVLKISSKFELRRFCRAAGAVAHLKLSRPSPDDLGYVDSISVEEIGGVTVTIARNEQGGNSISTVVLRGSTDSILDDLERAVDDGVNTYKAMCRDSRIVPGAAATEIELAQRLKEYANAETGLDKYAISKYAESFEFVPKTLADNAGLNAMEIIASLYTGHGSGNTKLGIDLEEGACKDVSETKVWDLFATKLFALKYASDAACTVLRVDQIIMAKQAGGPRRDAAAAAGAGAEED

SEQ ID NO: 6774 - protein, 544 aa, Brassica napus
MQPYGIQSMLKEGYRHLSGLDEAVIKNIEACKELSTITRTSLGPNGMNKMVINHLDKLFVTNDAATIVNELEIQHPAAKILVLAAKAQQEEIGDGANLTISFAGELLQNAEELIRMGLHPSEIICGYNKAIIKVVEVLEDLVESGSETMDVRNKDEVVSRMRAAVASKQFGQEEIICSLVADACIQVCPKNPTNFNVDNVRVAKLLGGGLHNSCIVRGMVLKSDAVGSIKRMEKAKVAVFAGGVDTTATETKGTVLIHSAEQLENYAKTEEAKVEELIKAVAESGAKVIVSGGSVGEMALHFCERYKIMVLKISSKFELRRFCRAAGAVAHLKLSRPSPDDLGYVDSISVEEIGGVTVTIARNEQGGNSISTVVLRGSTDSILDDLERAVDDGVNTYKAMCRDSRIVPGAAATEIELAQRLKEYANAETGLDKYAISKYAESFEFVPKTLADNAGLNAMEIIASLYTGHGSGNTKLGIDLEEGACKDVSETKVWDLFATKLFALKYASDAACTVLRVDQIIMAKQAGGPRRDAAAAAGAGAEED

SEQ ID NO: 6775 - protein, 228 aa, Raphanus sativus
  misc_feature (137)..(137): Xaa can be any naturally occurring amino acid
  misc_feature (140)..(140): Xaa can be any naturally occurring amino acid
  misc_feature (153)..(153): Xaa can be any naturally occurring amino acid
  misc_feature (155)..(155): Xaa can be any naturally occurring amino acid
MQPYGIQSMLKEGYRHLSGLDEAVIKNIEACKELSTITRTSLGPNGMNKMVINHLDKLFVTNDAATIVNELEIQHPAAKILVLAAKAQQEEIGDGANLTISFAGELLQNAEELIRMGLHPSEIISGYNKAIVKVVEXLEXLVESGSETMDVRXKXEVVSRMRAAVASKQFGQEEIICSLVADACIQVCPKNPTNFNVDNVRVAKLLGGGLHNSCIVRGMVLKMMLLGA

SEQ ID NO: 6776 - protein, 548 aa, Arabidopsis lyrata
MGISTQSHGIQSMLKEGYRHLSGLDEAVIKNIEACKELSTITRTSLGPNGMNKMVINHLDKLFVTNDAATIVNELEIQHPAAKILVLAAKAQQAEIGDGANLTISFAGELLQNAEELIRMGLHPSEIISGYTKASNKAVEYLEELVESGSESMDVRNKEEVVSRMRAAVASKQFGQEEIICSLVADACIQVCPKNPTNFNLDNVRIAKLLGGGLHNSCIVRGMVLKSDAIGSIKRMEKAKVAVFADGVDTTATETKGTVLIHSAEQLENYAKTEEAKVEELIKAVAESGAKVIVSGGSVGEMALHFCERYKLMVLKISSKFELRRFCRTTGAVAQLKLNRPSPDDLGYVDSISVEEIGGVRVTIARNEEGGNSISTVVLRGSTDSILDDLERAVDDGVNTYKAMCRDSRIVPGAAATEIELAQRLKKYANAETGLDKYAISKFAESFEFVPKTLADNAGLNAMEITASLYTGHGSGNAKLGIDLEEGVCKDVSDTKVWDLYSTKLFALKYAADAACTVLRVDQIIMAKPAGGPRRDAAAAAGAGMDED

SEQ ID NO: 6777 - protein, 544 aa, Quercus alba
MGLQMQSHGIQSMLKEGHKHLSGLDEAVLKNIDACKQLSLITRTSLGPNGMNKMVINHLDKLFVTNDAATIVNELEVQHPAAKILVLAGKAQQEEIGDGANLTISFAGELLQNAEELIRMGLHPSEIISGYTKAINKTVEILDELVENGSETMDVRNKDQVLSRIRAAVASKQFGQEDILCSLVADACIQVCPKNPANFNVDNVRVAKLLGGGLHNSTVVRGMVLKSDAVGSIKHIEKAKVAVFAGGVDSSATETKGTVLIHSAEQLENYSKTEEAKIEELIKSVADSGAKVIVSGAAVGEMALHFCERYKLMVLKISSKFELRRFCRTTGAVAMLKLSQPNPDDLGYVDSISVEEIGGARVIIVKNEEGGNSVSTVVLRGSTDSILDDLERAVDDGVNTYKAMCRDSRIVPGAAATEIELAKRVKEFSYKETGLDQYAIAKFAESFEMVPKTLAENAGLNAMEIISSLYAEHASGNSKVGIDLEEGVCKDVSTLCVWDLYITKFFALKYAADAACTVLRVDQIIMAKPAGGPKRDQPAGVDED

SEQ ID NO: 6778 - protein, 547 aa, Arachis hypogaea
MAPGFNIQPYGIQSMLKEGHKHLSGLDEAVLKNIDACKQLSTITRTSLGPNGMNKMVINHLDKLFVTNDAATIVNELEVQHPAAKILVLAGKAQQEEIGDGANLTISFAGEILQGAEELIRMGLHPSEIISGYTKAINKTIEILDELVEKGSETMDVRDKEQVISRMRAAVASKQYGQEDTICSLVADACIQVCPKNPANFNVDNVRVAKLLGGGLHNSTVVRGMVLKSDTVGTIKRIEKAKVAVFAGGVDTSATETKGTVLIHTAEQLENYSKTEEAKVEELIKAVAESGAKVVVSGGSVGEMALHFCERYKLMVLKISSKFELRRFCRTTGAVAMLKLGQPNPDDLGYVDSVSVEEIGGVRVTIVKNEEGGNSVATVVLRGSTDSILDDLERAVDDGVNTYKAMCRDSRTVPGAAATEIELAKRVKEFSFKETGLDQYAIAKFAESFEMIPRTLSENAGLNAMEIISSLYAEHASGNTKVGIDLEEGVCKDVSTMGVWDLHVTKFFALKYAADAACTVLRVDQIIMAKPAGGPRREQPAAGMDDD

SEQ ID NO: 6779 - protein, 545 aa, Lotus japonicus
MGFNMQSYGIQSMLKEGHKHLSGLDEAVIKNIDACKQLSTITRTSLGPNGMNKMVINHLDKLFVTNDAATIVNELEVQHPAAKILVLAGKAQQEEIGDGANLTISFAGELLQGAEELIRMGLHPSEIISGYTKAIAKTIEILDELVEKGSESMDVRDKVQVISRMRAAVASKQFGQEDTICSLVADACIQVCPKNPANFNVDNVRVAKLLGGGLHNSTVVRGMVLKSDAVGSIKRIEKAKVAVFVSGVDTSATDTKGTVLIHSAEQLENYSKTEEAKVEELIKAVADSGAKVIVSGGAVGEMALHFCERYKLMVLKISSKFELRRFCRTTGAVAVLKLSQPNPDDLGYVDSVSVEEVGGVTVTIVKNEEGGNSVSTVVLRGSTDSILDDLERAVDDGVNTYKAMCKDSRTVPGAAATEIELAKRVKDFSFKETGLDQYAIAKFAESFEMIPRTLAENAGLNAMEIISSLYAEHASGNTKVGIDLEEGVCKDVTTTHVWDLHVTKFFALKYAADAVCTVLRVDQIIMSKPAGGPRRGDKPAGMDED

SEQ ID NO: 6780 - protein, 545 aa, Populus trichocarpa
MGFSMQPYGMQSMLKEGHKHLSGLDEAVLKNIDACKQLSAITRTSLGPNGMNKMVINHLDKLFVTNDAATIVNELEVQHPAAKILVLAGKAQQEEIGDGANLTISFAGEMLQNADELIRMGLHPSEIISGYNKAINKAIEILSELVEPGSENMDVRNKEQVICRMKAAVASKQFGQEDILCNLIADACIQVCPKNPVNFNVDNVRVAKLVGGGLINSSIVRGMVLKGDTVGTIKRVEKAKVAVFAGGVDTSATETKGTVLIHSAEQLENYAKTEEAKVEELIKAVAETGAKVIVSGAAVGEMALHFCERYKLMVLKISSKFELRRFCRTTGAVAILKLSPPSPDDLGCVDSISVEEIGGARVTIVRNEEGGNSVCTVVLRGSTDSILDDLERAVDDGVNTYKAMCRDSRIIPGGAATEIELAKRLREFSFKETGLDQYAIAKFAESFEMIPKTLAENAGLNAMEIISSLYAEHASGNTKVGIDLEEGVFKDVSTTNIWDLYVTKFFALKYAADAACTVLRVDQIIMAKPAGGPRRDAAPGGMDED

SEQ ID NO: 6781 - protein, 545 aa, Vitis vinifera
MGFQMQPYGVQSMLKEGHKHLSGLEEAVLKNIDACKQLSVITRTSLGPNGMNKMVINHLDKIFVTNDAATIVNELEVQHPAAKILVLASKAQQEEIGDGANLTISFAGELLQNAEELIRMGLHPSEIISGYSKAINKTVEILEELVEKGSEKMDVRNKEQVISRMKAAVASKQFGQEDILCPLIADACIQVCPKNPVNFNVDNVRVAKLLGGGLHNCTVVRGMALKTDAVGSIKRVEKAKVAVFASGVDTSATETKGTVLIHSAEQLENYAKTEEAKIEELIKAVADSGAKVIVSGGAVGEMALHFCERYKLMVLKISSKFELRRFCRTTGAVAVLKLSQPNPDDLGYVDSVSVEEIGGVRVTIVKNEEGGNSVCTVVLRGSTDSILDDLERAVDDGVNTYKAMCRDSRIVPGAAATEIELARKLKEFSFKETGLDQYAIAKFAESFEMVPKTLAENAGLNAMEIISSLYAEHSTGNTKVGIDLDQGVVCKDVSTMNVWDLYITKYFALKYAADAACTVLRVDQIIMAKPAGGPKRDPAAGMDED

SEQ ID NO: 6782 - protein, 544 aa, Manihot esculenta
MGFSMQPYGIQSMLKEGHKHLSGLDEAVLKNIDACKQLSTITRTSLGPNGMNKMVINHLDKLFVTNDAATIVNELEVQHPAAKILVLAGKAQQEEIGDGANLTISFAGELLQNAEELIRMGLHPSEIISGYSKGINKAIEILDELVEKDSETMDVRSKEQVISRMKAAVASKQFGLEDILSNLIADACIQVCPKNPANFNVDNVRVAKLVGGGLHDCKIVRGMVLKSDTVGTIKRVEKAKVAVFAGGVDTSATETKGTVLIHSANQLENYAKTEEAKVEELIKAVADSGAKVIVSGAAVGEMALHFCERYKLMVLKISSKFELRRFCRTTGAIAHLKLSQPNPDDLGYVDSISVEEIGGARVTIVKNEEGGNSVCTVVLRGSTDSILDDLERAVDDGVNTYKAMCRDSRIIPGAAATEIELARRLKEFSFKETGLDQYAIAKFAESFEMVPKTLAENAGLNAMEIISSLYAEHASGNTKVGIDLDEGVCKDMSAMSIWDLYVTKFFALKYAADAACTVLRVDQIIMAKPAGGPKRDPPAGVDED

SEQ ID NO: 6783 - protein, 545 aa, Populus trichocarpa
MGFSMQPYGIQSMLKEGHKHLSGLDEAVLKNIDACKQLSTITRTSLGPNGMNKMVINHLDKLFVTNDAATIVNELEVQHPAAKILVLAGKAQQEEIGDGANLTISFAGEILQNADELIRMGLHPSEIISGYNKSIDKAIEILGELVEPGSENMDVRNKEQVIFRMKAAVASKQFGQEDVLCNLISEACIQVCPKNPANFNVDNVRVAKLVGGGLNNSSTVRGMVLKGDTVGTLKRVEKAKVAVFVGGVDTSATETKGTVLIHSAEQLENYAKTEEAKVEELIKAVANSGAKVIVSGAAVGEMALHFCERYKLMVLKISSKFELRRFCRTTGAVAILKLSPPNPDDLGYVDSISVEEIGGTRVTVVRNEEGGNSVCTVVLRGSTDSILDDLERAVDDGVNTYKAMCRDSRIVPGGAATEIELAKRLKEFSFKETGLDQYAIAKFAESFEMIPKTLAENAGLNAMEIISSLYADHASGNIKVGIDLEEGVCKDVSTLKIWDLYVTKFFALKYATDAACTVLRVDQIIMAKPAGGPRRDAAPGGMDED

SEQ ID NO: 6784 - protein, 544 aa, Manihot esculenta
MGFSMQPYGIQSMLKEGHKHLSGLDEAVLKNIDACKQLSTITRTSLGPNGMNKMVINHLDKLFVTNDAATIVNELEVQHPAAKILVLAGKAQQEEIGDGANLTISFAGELLQNAEELIRMGLHPSEIISGYNKGINKTIEILDELVEKGSDTMDVRNKEQVISRMKAAVASKQFGQEDTLSNLIADACIQVCPKNPANFNVDNVRVAKLVGGGLHDCTIVRGMILKNDTVGTIKRVEKAKVAVFAGGVDTSATETKGTVLIHSAEQLENYAKTEEAKVEELIKAVADSGAKVIVSGAAVGEMALHFCERYKLMVLKISSKFELRRFCRTTGAVAILKLSQPNPDDLGYVDSISIEEIGGARVAIVKNEAGGNSVCTVVLRGSTDSILEDLERAVDDGVNTYKAMCRDSRIVPGAAATEIELARRLKEFSFKETGLDQYAIAKFAESFEMVPKTLAENAGLNAMEIISSLYAEHASGNTKVGIDLEEGVCKDMSTMNIWDLYVTKFFALKYAADAACTVLRVDQIIMAKPAGGPKRDPAAGMDED

SEQ ID NO: 6785 - protein, 545 aa, Cucumis sativus
MGFQMPSHGIQSMLKEGHKHFSGLDEAVLKNIDACKQLSTITRTSLGPNGMNKMVINHLDKLFVTNDAATIVNELEVQHPAAKLLVLAGKAQQEEIGDGANLTISFAGELLQNAEELIRMGLHPSEIISGYTKGINKTIEVLKELVEKGSENMDVRNKEEVVSRMKAAVASKQFGQEDFICSLVADACIQVCPKNPENFNVDNVRVAKLLGGGLHNSSVVRGMVLKSDAVGSIKRIEKAKVAVFAGGVDTSATETKGTVLIHTAEELQNYAKTEEAKVEELIKAVADSGAKVIVSGAAVGEMALHFCERYKLMVLKISSKFELRRFCRTTGAVAMLKLSPPNPDDLGHVDSVSVEEIGGVRVTVVKNEEGGNSISTVVLRGSTDSILDDLERAVDDGVNTYKAMAKDSRTVPGAAATEIELARRVKEFSFKETGLDQYAIAKFAESFEMVPKTLSENAGLNAMEIISSLYAEHASGNTRVGIDLEEGICKDVSTMNIWDLYITKFFALKYAADAVCTVLRVDQIIMSKPAGGPRRGDQPAGMDED

SEQ ID NO: 6786 - protein, 544 aa, Cajanus cajan
MGFNIQPYGIQSMLKEGHKHLTGLDEAVLKNIDACKQLSTITRTSLGPNGMNKMVINHLDKLFVTNDAATIVNELEVQHPAAKVLVLAGKAQQEEIGDGANLTISFAGELLQGAEELIRMGLHPSEIISGYTKAINKTVQILDELVEDGSENMDVRDKEQVVSRMKAAVASKQFGQEDSICSLVTDACIQVCPKNPANFNVDNVRVAKLLGGGLHNSTVVRGMVLKSDAIGTIKQAEKAKVAVFAGGVDTSATETKGTVLIHTAEQLENYSKTEEAKVEELIKAVADSGAKVIVSGGSVGEMALHFCERYKLMVLKISSKFELRRFCRTTGSVAMLKLGQPNPDDLGYVDSVSVEEIGGVRVIIVKNEEGGNSVATVVLRGSTDSILDDLERAVDDGVNTYKAMCRDSRIVPGAAATEIELAKRVKDFSFKETGLDQYAIAKFAESFEMIPRTLAENAGLNAMEIISSLYAEHASGNAKVGIDLEEGVCKDVSTLSIWDLHVTKFFALKYAADAACTVLRVDQIIMSKPAGGPRREQPAGMDED

SEQ ID NO: 6787 - protein, 545 aa, Glycine max
MGFNIQPYGIQSMLKEGHKHLSGLDEAVLKNIDACKQLSTITRTSLGPNGMNKMVINHLDKLFVTNDAGTIVNELEVQHPAAKVLVLAGKAQQEEIGDGANLTISFAGELLQGAEELIRMGLHPSEIISGYTKAINKTVQILDELVEDGSDNMDVRDKEQVISRMKAAVASKQFGQEDIICSLVADACIQVCPKNPANFNVDNVRVAKLLGGGLHNSTVVRGLVLKSDAVGTIKQAEKAKVAVFASGVDTSATETKGTVLIHTAEQLENYSKTEEAKVEELIKAVADSGAKVIVSGGAVGEMALHFCERYKLMVLKISSKFELRRFCRTTGSVAMLKLCQPNPDDLGYVDSVSVQEIGGVRVTIVKNEEGGNSVATVVLRGSTDSILDDLERAVDDGVNTYKAMCRDSRFVPGAAATEIELAKRVKDFSFKETGLDQYAIAKFAESFEMIPRTLAENAGLNAMEIISSLYAEHASGNAKVGIDLEEGICKDVSTLSIWDLHVTKLFALKYAADAACTVLRVDQIIMAKPAGGPRREQPAGGMDED

SEQ ID NO: 6788 - protein, 545 aa, Vigna unguiculata
  misc_feature (294)..(294): Xaa can be any naturally occurring amino acid
MGFNIQPYGIQSMLKEGHKHLSGLDEAVLKNIDACKQLSTITRTSLGPNGMNKMVINHLDKLFVTNDAATIVNELEVQHPAAKVLVLAGKAQQEEIGDGANLTISFAGELLQGAEELIRMGLHPSEIISGYTKAINKTVQILDDLVEEGSETMDVRDKEQIVSRMKAAVASKQFGLENTICSLVADACIQVCPKNPANFNVDNIRVAKLLGGGLHNSTVVRGMVLKSDAVGTVKQAEKAKVAVFAGGVDTSATETKGTVLIHSAEQLENYSKSEEAKIEELIKAVADSGAKVIXSGGAVGEMALHFCERYKLMVLKISSKFELRRFCRTTGSVAMLKLSQPNPDDLGYVDSVSVQEIGGVRVTIVKNEEGGNSVATVVLRGSTDSILDDLERAVDDGVNTYKAMCRDSRIVPGAAATEIELAKRVKDFSFGETGLDQYAIAKFAESFEMIPRTLAENAGLNAMEIISSLYAEHASGNAKVGIDLEEGVCKDVSTLGIWDLHVTKLFALKYAADAACTVLRVDQIIMAKPAGGPRRGEQPAGADED

SEQ ID NO: 6789 - protein, 545 aa, Glycine max
MGFNLQPYGIQSMLKEGHKHLSGLDEAVLKNIDACKQLSTITRTSLGPNGMNKMVINHLDKLFVTNDAGTIVNELEVQHPAAKVLVLAGKAQQEEIGDGANLTISFAGELLQGAEELIRMGLHPSEIISGYTKAINKTVQILDELVENGSESMDVRDKEQVVSRMKAAVASKQFGQEDTLCSLVADACIQVCPKNPANFNVDNVRVAKLLGGGLHNSTVVRGLVLKSDAVGIIKQAEKAKVAVFAGGVDTSATETKGTVLIHTAEQLENYSKTEEAKVEELIKAVADSGAKVIVSGGAVGEMALHFCERYKLMVLKISSKFELRRFCRTTGSVAMLKLGQPNPDDLGYVDSVSVQEIGGVRVTIVKNEEGGNSVATVVLRGSTDSILDDLERAVDDGVNTYKAMCRDSRFVPGAAATEIELAKRVKDFSFKETGLDQYAIAKFAESFEMIPRTLAENAGLNAMEIISSLYAEHASGNAKVGIDLEEGVCKDVSTLSIWDLHVTKLFALKYAADAACTVLRVDQIIMAKPAGGPRREQPAGGMDED

SEQ ID NO: 6790 - protein, 541 aa, Prunus persica
MQPYGIQSMLKEGHKHLSGLDEAVVKNIDACKQLSTITRTSLGPNGMNKMVINHLDKLFVTNDAATIVNELEVQHPAAKLLVLAGRAQQEEIGDGANLTISFAGELLQNAEELIRMGLHPSEIISGYNKAITKTIEILDELVEEGSEKMNVRNKEEVVCRMKAAVASKQFGQEDILSSLVADACIQVCPKNPANFNVDNVRVAKIVGGGLHNCTVVRGMVLKTDAVGSIKRMEKAKVAVFVSGVDTSATETKGTVLIHSADQLENYAKTEEAKVEELIKAVADSGAKVIVSGAAVGEMALHFCERYKLMVLKISSKFELRRFCRTTGAVAMLKLGQPNPDDLGYVDSVSVEEIAGVRVTVVKNEEGGNSVSTVLLRGSTESILDDLERAVDDGVNTYKAMCKDSRIVPGAAATEIELARRLKEFSFKETGLDQYAIAKFAESFEMVPKTLAENAGRNAMEIISSLYAEHASGNTKVGIDLEDGVCRDVSALNVWDLHITKFFALKYAADAACTVLRVDQIIMAKPAGGPSRRDQPAGMDED

SEQ ID NO: 6791 - protein, 541 aa, Triphysaria pusilla
MQPYGIQSMLKEGHRHLSGVEEAVLKNIDACKQLSTITRTSLGPNGMNKMVINHLDKLFVTNDAATIVNELEVQHPAAKLLVLAGKAQQEEIGDGANLTVSFAGELLQNAEELIRMGLHPSEIIVGYTKAIKKALEILDELVEEGSETMNVRDTDEVISRMKSTVASKQFGQEDKLCSLIAEACIQVCPKNPMNFNVDNVRVAKLLGGGLHDSTVVQGLVLKSDAIGSIKRIEKAKVAVFVGGVDTTATETKGTVLIHNAEQLENYAKTEEAKVEELIKAVADSGAKVVVSGSAVGEMALHFCERYKLMVVKISSKFELRRFCRTTGAVAHLKLSQPGPDDLGYVDSISVEEIGGARVTIVKNEQGGNSVSTVVLRGSTDSILDDLERAVDDGVNAYKAMCRDSRTVPGAAATEIELAKRLKEFSFKETGLDQYAIAKFAESFEMIPKTLAENAGLNAIEIISSLYAEYASGNTKVGIDLEEGACKDVSTMKIWDLHITKFFALKYAADAACTVLRVDQIIMSKPAGGPKRDPPAGMDNED

SEQ ID NO: 6792 - protein, 546 aa, Ricinus communis
MGFSMQPYGIQGMLKEGHKHLSGLDEAVLKNIDACKQLSSITRTSLGPNGMNKMVINHLDKLFVTNDAATIVNELEVQHPAAKILVLAGKAQQEEIGDGANLTISFAGELLQNAEELIRMGLHPSEIISGYNKGINKTIEILDELVEEGSETMDVRNKEQVIFRMRAAVASKQFGQEDILCNLISDACIQVCPKNPVNFNVDNVRVAKLVGGGLHNSTIVRGMVLKSDAVGTIKRVEKAKVAVFVGGVDTSATETKGTVLIRSAEQLENYAKTEEAKIEELIKSVADSGVKVIVSGAAVGEMALHFCERYKLMVLKISSKFELRRFCRTTGAVAILKLSQPNPDDLGYIDSISVEEIGGVRVTVVKNEEGGNSVCTVVLRGSTESILEDLERAIDDGVNTYKAMCRDCRIIPGAAATEIELARKLKEFSFKETGLDQYAIAKFAESFEMVPKTLAENAGLNAMEIISSLYAEHASGNIKVGIDLDGGVCKDISTLNIWDLYVTKYFALKYAADAASTVLRVDQIIMAKPAGGPRRDQQPAGGMDED

SEQ ID NO: 6793 - protein, 542 aa, Mimulus guttatus
MVGYSYGIQSMLKDGHRHMSGLDEAVLKNIDACKQLSTITRTSLGPNGMNKMVINHLDKLFVTNDAATIVNELEVQHPAAKLLVLAGKAQQEEIGDGANLTVSFAGELLQKAEELIRMGLHPSEIIIGYTKAINKTIEILEELVEEGSENMNVRDKEDVISRMRSAVASKQFGQEDILCPLIAEACIQVCPKNPVNFNVDNVRVAKLVGGGLHDSAVVRGMVLKNDAVGTIKRMEKAKVAVFVGGVDTTATETKGTVLIHNAEQLENYAKTEEAKVEELIKAVADSGAKVIVSGSAVGEMALHFCERYKLMVLKISSKFELRRFCRTTGAVALLKLSQPNPDDLGYVDSVSVEEIGGARVTIVKNEQGGNSVSTLVLRGSTDSILDDLERAVDDGVNTYRAMCRDSRIVPGAAATEIELAKRLKEFSFKETGLDQYGIAKFAESFEMIPKTLAENAGLNAIEIISSLYAEHASGNTKVGIDLEEGVCKDASTVRIWDLHITKFFALKYAADAACTVLRVDQIIMAKPAGGPKPQQQGGMDED

SEQ ID NO: 6794 - protein, 545 aa, Mimulus guttatus
MVGFSTQPYGIQSMLKDGHRHMSGLDEAVLKNIDACKQLSTITRTSLGPNGMNKMVINHLDKLFVTNDAATIVNELEVQHPAAKLLVLAGKAQQEEIGDGANLTVSFAGELLQNAEELIRMGLHPSEIIIGYTKAINKTIEILEELVEEGSQTMNVRDKDDVISRMRSAVASKQFGQEDILCPLIAEACIQVCPKNPVNFNVDNVRVAKLVGGALHDSVVVRGLVLKNDAVGTIKKAENAKVAVFVGGVDTTATETKGTVLIHNANQLENYAKTEEAKVEELIKAVADSGAKVIVSGAAVGEMALHFCERYKLMVLKISSKFELRRFCRTTGAVALLKLSQPSADDLGYVDSISVEEIGGARVTIVKNEQGGNSVSTLVLRGSTDSILDDLERAVDDGVNTYRAMCRDSRIVPGAAATEIELAKRLKEFSFKETGLDQYGIAKFAESFEMIPKTLAENAGLNAIEIISSLYAEHASGNTKVGIDLEEGVCKDASTVRIWDLHITKFFALKYAADAACTVLRVDQIIMAKPAGGPKPQQQGGMDED

SEQ ID NO: 6795 - protein, 550 aa, Gossypium hirsutum
MGFSMQPYGIQSMLKEGHKHLSGLDEAVLKNIDACKQLSTITRTSLGPEGMNKMVINHLDKLFVTNDAATIVNELEVQHPAAKILVLAGKAQQEEIGDGANLTISFAGELLQNAEELIRMGLHPSEIISGYTKSISKAIEVLGELVEKGSETMDVRNKEQVVTRMKAAVASKQHGQEDILCSLIADACIQVCPKNPANFDVDNVRVSKLVGGGLHNCTIVRGMVLKGDAVGSIKRMEKAKVAVFASGVDSSATETKGTVLIHSAEQLENYSKTEEAKVEELIKAVADSGAKVIVSGGAVGEMALHFCERYKLMVLKISSKFELRRFCRTTGTSALLKLSQPKPDDLGFVDSISVEEIGGSRVTVVRSEEGGNKIATVVLRGSTDSILDDLERAVDDGVNTYKAMCRDSRMVPGAAATEIELARRLKEFSFKETGLDQYAIAKFAESFEMVPRTLAENAGLNPMDIISKLYEKHASGNTKVGIDLGGGDSEDGVCKDVSTLNIWDLYVTKFFALKYAADAACTVLRVDQIIMAKPAGGPGRREQPAGMDED

SEQ ID NO: 6796 - protein, 550 aa, Gossypium hirsutum
MGFSMQPYGIQSMLKEGHKHLSGLDEAVLKNIDACKQLSTITRTSLGPEGMNKMVINHLDKLFVTNDAATIVNELEVQHPAAKILVLAGKAQQEEIGDGANLTISFAGELLQNAEELIRMGLHPSEIISGYTKSISKAIEVLGELVEKGSETMDVRNKEQVVTRMKAAVASKQHGQEDILCSLIADACIQVCPKNPANFDVDNVRVSKLVGGGLHNCTIVRGMVLKGDAVGSIKRMEKAKVAVFASGVDSSATETKGTVLIHSAEQLENYSKTEEAKVEELIKAVADSGAKVIVSGGAVGEMALHFCERYKLMVLKISSKFELRRFCRTTGTSALLKLSQPKPDDLGFVDSISVEEIGGSRVTVVRSEEGGNKIATVVLRGSTDSILDDLERAVDDGVNTYKAMCRDSRMVPGAAATEIELARRLKEFSFKETGLDQYAIAKFAESFEMVPRTLAENAGLNPMDIISKLYEKHASGNTKVGIDLGGGDSEDGVCKDVSILNIWDLYVTKFFALKYAADAACTVLRVDQIIMAKPAGGPGRREQPAGMDED

SEQ ID NO: 6797 - protein, 542 aa, Sorghum bicolor
MAGYGIQSMLKEGHRHLSGLEEAVLKNIDACRELSAITRTSLGPNGMNKMVINHLDKLFVTNDAATIVNELEVQHPAAKILVLAGRAQQEEIGDGANLTISFAGELLEKAEELIRMGLHPSEIIIGYTKAINKTIEILEDLVEKGSENMDVRNKEEVVLRMRSAVASKQFGQEDIMCPLVADACIQVCPKNPANFNVDNVRVAKLLGGGLHNSSVVRGMVLKNDAVGSIKRVEKAKIAVFAGGVDTSATETKGTVLIHSAEQLENYAKTEEAKVEELIKAVADSGAKVIVSGAAVGDMALHFCERYKLMVLKISSKFELRRFCRTTGAIAILKLSQPNAEELGYADSVSVEEIGGTRVTVVKNEEGGNSVATVVLRGSTDSILDDLERAVDDGVNTYKSMCRDSRIIPGAAATEIELAKRLKEFSLKETGLDQYAIAKFAESFEMVPRTLAENAGLSAMEIISSLYAEHASGNVKVGIDLEEGACKDISTLKIWDLYVTKFFALKYSADAACTVLRVDQIIMAKPAGGPRRDAQPGGGMDED

SEQ ID NO: 6798 - protein, 542 aa, Triphysaria pusilla
MQPYGIQSMLKEGHRHLSGVEEAVLKNIDACKQLSTITRTSLGPNGMNKMVINHLDKLFVTNDAATIVNELEVQHPAAKLLVLAGKAQQEEIGDGANLTVSFAGELLQNAEELIRMGLHPSEIIVGYTKAIKKALEILDELVEEGSETMNVRDTDEVISRMKSTVASKQFGQEDKLCSLIAEACIQVCPKNPMNFNVDNVRVAKLLGGGLHDSTVVQGLVLKSDAIGSIKRIEKAKVAVFVGGVDTTATETKGTVLIHNAEQLENYAKTEGAKVEELIKAVADSSAKVVVSGSAVGEMALHFCERYKLMVVKISSKFELRRFCRTTGAVAHLKLSQPGPNDLGYVDSISVEEIGGARVTIVKNEQGGNSVSTVVLRGSTDSILDDLERAVDDGVNAYKAMCRDSRTVPGAAATEIELAKRLKEFSFKETGLDQYAIAKFAESFEMIPKTLAENAGLNAIEIISSLYAEHASGNIKVGIDLEEGACKDVATMKIWDLHITKLFALKYAADAACTVLRVDQIIMSKPAGGPNKRDPPAGMDNED

SEQ ID NO: 6799 - protein, 541 aa, Prunus persica
  misc_feature (416)..(416): Xaa can be any naturally occurring amino acid
  misc_feature (418)..(418): Xaa can be any naturally occurring amino acid
  misc_feature (420)..(420): Xaa can be any naturally occurring amino acid
  misc_feature (482)..(482): Xaa can be any naturally occurring amino acid
  misc_feature (486)..(486): Xaa can be any naturally occurring amino acid
MQPYGIQSMLKEGHKHLSGLDEAVVKNIDACKQLSTITRTSLGPNGMNKMVINHLDKLFVTNDAATIVNELEVQHPAAKLLVLAGRAQQEEIGDGANLTISFAGELLQNAEELIRMGLHPSEIISGYNKAITKTIEILDELVEEGSEKMNVRNKEEVVCRMKAAVASKQFGQEDILSSLVADACIQVCPKNPANFNVDNVRVAKIVGGGLHNCTVVRGMVLKTDAVGSIKRMEKAKVAVFVSGVDTSATETKGTVLIHSADQLENYAKTEEAKVEELIKAVADSGAKVIVSGAAVGEMALHFCERYKLMVLKISSKFELRRFCRTTGAVAMLKLGQPNPDDLGYVDSVSVEEIAGVRVTVVKNEEGGNSVSTVLLRGSTESILDDLERAVDDGVNTYKAMCKDSRIAPGAAATEIXLXRXLKEFSFKETGLDQYAIAKFAESFEMVPKTLAENAGRNAMEIISSLYAEHASGNTKVGIDLEXGVCXDVSALNVWDLHINKFFALKYAADAACTVLRVDQIIMAKPAGGPSRRDQPAGMDED

SEQ ID NO: 6800 - protein, 540 aa, Oryza sativa
MPGYGIQSMLKEGHKHLSGLDEAVLKNIDACRELSAITRTSLGPNGMNKMVINHLDKLFVTNDAATIVNELEVQHPAAKILVLAGRAQQEEIGDGANLTISFAGELLEKAEELIRMGLHPSEIIIGYTKAINKTVEILEDLVEKGSENMDVRNKEEVVLLMRSAVASKQFGQEDILCPLVADACMQVCPKNPANFNVDNVRVAKLLGGGLHNSSVVRGMVLKNDAVGSIKRVEKAKIAVFAGGVDTSATETKGTVLIHSAEQLENYAKTEEAKVEELIKAVADSGAKVIVSGAAVGDMALHFCERYKLMVLRISSKFELRRFCRTTGSIALLKLSRPNADELGYADSVSVEEIGGARVTVVKNEEGGNSVATVVLRGSTDSILDDLERAVDDGVNTYKSMCRDSRIIPGAAATEIELARRLKEFSLKETGLDQYAIAKFAESFEMVPRTLAENAGLSAMEIISSLYAEHAGGNTKVGIDLEEGGCKDVSIMKIWDLYVTKLFALKYSADAACTVLRVDQIIMAKPAGGPRRDAQPGMDED

SEQ ID NO: 6801 - protein, 542 aa, Saccharum officinarum
MASYGIQSMLKEGHRHLSGLEEAVLKNIDACRELSAITRTSLGPNGMNKMVINHLDKLFVTNDAATIVNELEVQHPAAKILVLAGRAQQEEIGDGANLTISFAGELLGKAEELIRMGLHPSEIIIGYTKAINKTIEILEDLVEKGSENMDVRNKEEVVLRMRSAVASKQFGQEDVLCPLVADACIQVCPKNPTNFNVDNVRVAKLLGGGLHNSSVVRGMVLKNDAVGSIKKVEKAKIAVFAGGVDTSATETKGTVLIHSAEQLENYAKTEEAKVEELIKAVADSGAKVIVSGAAVGDMALHFCERYKLMVLKISSKFELRRFCRTTGAIAILKLSQPNADELGYADSVSVEEIGGTRVTVVKNEEGGNSVATGVLRGSTDSILDDLERAVDDGVNTYKSMCRDSRIIPGAAATEIELAKRLKEFSLKETGLDQYAIAKFAESFEMVPRTLAENAGLSAMEIISSLYAEHASGNVKVGIDLEEGACKDISTLKIWDLYVTKFFALKYSADAACTVLRVDQIIMAKPAGGPRRDAQPGGGMDED

SEQ ID NO: 6802 - protein, 542 aa, Pennisetum glaucum
MPGYAIQNMLKEGHRHLSGLDEAVLKNIDACRELSTITCTSLGPNGMNKMVINHLDKLFVTNDAATIVNELEVQHPAAKILVLASRAQQEEIGDGANLTISFAGELLEKAEELIRMGLHPSEIIIGYNKAINKTIEILEDLVEKGSENMDVRNKEEVVLRMRSAVASKQFGQEDILCPLVADACMQVCPKNPANFNVDNVRVAKLVGGGLHNSAVVRGMVLKNDAVGSIKRVEKAKIAVFAGGVDTSATETKGTVLIHSAEQLENYAKTEEAKVEELIKAVADSGAKVIVSGGAVGDMALHFCERYKLMVLKISSKFELRRFCRTTGSVAILKLSQPNADELGYADSVSVEEIGGARVTVVKNEEGGNSVATVVLRGSTDSILDDLERAVDDGVNTYKSMCRDSRIIPGAAATEIELAKRLKEFSLKETGLDQYAIAKFAESFEMVPRTLSENAGLNAMEIISSLYAEHAAGNTKVGIDLEEGACKDVSTLKIWDLYVTKFFALKYSADAVCTVLRVDQIIMAKPAGGPRRDAQPGGGMDED

SEQ ID NO: 6803 - protein, 542 aa, Zea mays
MAGYGIQSMLKEGHRHLSGLEEAVLKNIDACRELSAITRTSLGPNGMNKMVINHLDKLFVTNDAATIVNELEVQHPAAKILVLAAKAQQEEIGDGANLTISFAGELLEKAEELIRMGLHPSEIIIGYTKAINKTIEILEDLVEKGSENMDVRNKEDVVLRMRSAVASKQFGQEDMLCPLVADACIQVCPKNPANFNVDNVRVAKLLGGGLHNSSVVRGMVLKNDAVGSIKRAEKAKIVVFAGGVDTSATETKGTVLIHSAEQLENYAKTEEAKVEELIKAVADSGAKVIVSGAAVGDMALHFCERYKLMVLKISSKFELRRFCRTTGAVAILKLSQPNADELGYADSVSVEEIGGTRVTVVKNEDGGNSVATVVLRGSTDSILDDLERAVDDGVNTYRSMCRDSRIIPGAAATEVELAKRLKEFSLKETGLDQYAIAKFAESFEMVPRTLAENAGLSAMEIISSLYAEHASGNAKVGIDLEEGACKDISTLKIWDLYVTKFFALKYSADAACTVLRVDQIIMAKPAGGPRRDAQPGGGMDED

SEQ ID NO: 6804 - protein, 542 aa, Panicum virgatum
MPGYGIQSMLKEGHRHLSGLEEAVLKNIDACGELSAITRTSLGPNGMNKMVINHLDKLFVTNDAATIVNELEVQHPAAKILVLAGRAQQEEIGDGANLTISFAGELLQKAGELIRMGLHPSEIIIGYTKAINKTIEILEDLVEKGSENMDVRNKEEVVLRMRSAVASKQFGQEDILCPLVADACMQVCPKNPANFNVDNVRVAKLVGGGLRNSTVVRGMVLKNDAVGSIKRVEKAKIAVFAGGVDTSATETKGTVLIHSAEQLENYAKTEEAKVEELIKAVADSGAKVIVSGAAVGDMALHFCERYKLMVLKISSKFELRRFCRTTGAVAILKLSQPNADELGYADSVSVEEIGGARVTVVKNEEGGNSVATVVLRGSTDSILDDLERAVDDGVNTYKSMCRDSRIIPGAAATEIELAKRLKEFSLKETGLDQYAIAKFAESFEMVPRTLSENAGLNAMEIISSLYAEHAAGNTKVGIDLEEGVCKDVSVLKIWDLYVTKFFALKYSADAVCTVLRVDQIIMAKPAGGPRRDAQPGGGMDED

SEQ ID NO: 6805 - protein, 541 aa, Orobanche aegyptiaca
MAPYGIQSMLKEGHRHMSGLEEAVIKNIDACKQLSTITRTSLGPNGMNKMVINHLDKLFVTNDAATIVNELEVQHPAAKILVLAGKAQQEEIGDGANLTVSFAGELLQNAEELIRMGLHPSEIIVGYTKAINKTIQLLEELVEEGSGSMNVRDKDEVILRMRSSVASKQFGQEDILCPLIAEACIQVCPKNPANFNVDNVRVAKLLGGGLHGSTVVRGLVLKSDAIGTIKRMEKAKVAVFAGGVDTTATETKGTVLIHSAEQLENYSKTEEAKVEELIKAVAESGAKIIVSGAAVGEMALHFCERYKLMVLKISSKFELRRFCRTTGAIGLLKLSQPDPDDLGYVDSVSVEEIGGARVTIVKNEQGGNSVATVVLRGSTDSILDDLERAVDDGVNAYKAMCKDSRTVPGAAATEIELAKRLKEFSFKETGLDQYAIAKFAESFEMIPKTLAENAGLNAIEIISSLYAEHASGNTKVGIDLEEGVCKDISTLKIWDLHITKFFALKFAADAACTVLRVDQIIMAKPAGGPKRDPPAGMDNED

SEQ ID NO: 6806 - protein, 542 aa, Saccharum officinarum
  misc_feature (361)..(361): Xaa can be any naturally occurring amino acid
  misc_feature (447)..(447): Xaa can be any naturally occurring amino acid
MASYGIQSMLKEGHRHLSGLEEAVLKNIDACRELSAITRTSLGPNGMNKMVINHLDKLFVTNDAATIVNELEVQHPAAKILVLAGRAQQEEIGDGANLTISFAGELLGKAEELIRMGLHPSEIIIGYTKAINKTIEILEDLVEKGSENMDVRNKEEVVLRMRSAVASKQFGQEDVLCPLVADACIQVCPKNPTNFNVDNVRVAKLLGGGLHNSSVVRGMVLKNDAVGSIKKVEKAKIAVFAGGVDTSATETKGTVLIHSAEQLENYAKTEEAKVEELIKAVADSGAKVIVSGAAVGDMALHFCERYKLMVLKISSKFELRRFCRTTGAIAILKLSQPNADELGYADSVSVEEIGGTRVTVXKNEEGGNSVATGVLRGSTDSILDDLERAVDDGVNTYKSMCRDSRIIPGAAATEIELAKRLKEFSLKETGLDQYAIAKFAESFEMVXRTLAENAGLSAMEIISSLYAEHASGNVKVGIDLEEGACKDILTLKIWDLYVTKFFALKYSADAACTVLRVDQIIMAKPAGGPRRDAQPGGGMDED

SEQ ID NO: 6807 - protein, 541 aa, Solanum lycopersicum
MQPYGIQSMLKEGHKHLSGLDEAVLKNIDACKQLSTITRTSLGPNGMNKMVINHLDKLFVTNDAATIVNELEVQHPAAKILVLAGKAQQEEIGDGANLTVSFAGELLQNAEELIRMGLHPSEIIIGYNKAINKTIELLDELVEAGSENMNVKDKNEVISRMKSAVASKQFGLEDVLCPLVAEACIQVCPKNPANFNVDNVRVAKLLGGGLHNSTIVRGMVLKSDAVGSIKRIEKAKVAVFVQGVDTSTTETKGTVLIHSAEQLENYAKTEEAKVEELIKSVADSGAKVIVSGAAVGEMALHFCERYKLMVLKISSKFELRRFCRTTGAVALLKLSQPNPDDLGHVDSVSVEEIGGVRVTVVRNEDGGNSVSTVVLRGSTDSILDDLERAVDDGVNTYKAMCRDSRIVPGAAATEIELARKLKEFSFKEMGLDQYAIAKFAESFEMVPKTLAENAGLNAMEIISSLYAEHASGNVKVGLNLEKGACEDISGLSIWDLYVTKYFALKYAADAVCTVLRVDQIIMSKPAGGPGRREQPAGMDED

SEQ ID NO: 6808 - protein, 549 aa, Theobroma cacao
  misc_feature (220)..(220): Xaa can be any naturally occurring amino acid
  misc_feature (224)..(224): Xaa can be any naturally occurring amino acid
  misc_feature (243)..(243): Xaa can be any naturally occurring amino acid
MGFSMQPYGIQSMLKEGHKHLSGLDEAVLKNIDACKQLSTITRTSLGPDGMNKMVINHLDKLFVTNDAATIVNELEVQHPAAKILVLAGKAQQEEIGDGANLTISFAGELLQNAEELIRTGLHPSEIISGYTKAINKTIEVLSELVEKGSEKMDVRNKEQVVTRMKAAVASKQHGQEDILCSLIADACIQVCPKNPANFDVDNVRVSKLVGGGLHNCTIXRGMXLKGDAVGSIKRMEKAKVAXFASGIDTSATETKGTVLIHSAEQLENYAKTEEAKVEELIKAVADSGAKVIVSGGAVGEMALHFCERYKLMVLKISSKFELRRFCRTTGTAALLKLSQPKPDDLGFVDSVSVEEIGGSRVTVVRSEEGGNRVATVVLRGSTDSILDDLERAVDDGVNTYKAMCRDSRIVPGAAATEIELARRLKEFSFKETGLDQYAIAKFTESFEMVPRTLAENAGLNPMDVISKLYEKHASGNTKVGIDLGGGDSEDGVCKDASTMSIWDLYVTKFFALKYATDAACTVLRVDQIIMAKPAGGPRRDQPAGMDED

SEQ ID NO: 6809 - protein, 542 aa, Zea mays
MAGYGIQSMLKEGHRHLSGLEEAVLKNIDACRELSAITRTSLGPNGMNKMVINHLDKLFVTNDAATIVNELEVQHPAAKILVLAGRAQQEEIGDGANLTISFAGELLEKAEELIRMGLHPSEIIIGYTKAINKTIEILEDLVEKGSENMDVRNKEDVVLRMRSAVASKQFGQEDIMCPLVADACIQVCPKNPANFNVDNVRVAKLLGGGLHNSSVVRGMVLKNDAVGSIKRVEKAKIAVFAGGVDTSATETKGTVLIHSAEQLENYAKTEEAKVEELIKAVADSGAKVIVSGAAVGDMALHFCERYKLMVLKISSKFELRRFCRTTGAVAILKLSQPNADELGYADSVSVEEIGGTRVIVIKNEEGGNSVATVVLRGSTDSILDDLERAVDDGVNTYKSMCRDSRIIPGAAATEIELAKRLKEFSLKETGLDQYAVAKFAESFEMVPRTLAENAGLSAMDVISSLYAEHASGNVKVGIDLEEGACKDITTLKIWDLYVTKFFALKYSADAACTVLRVDQIIMAKPAGGPRRDAQPGGGMDED

SEQ ID NO: 6810 - protein, 547 aa, Helianthus annuus
MGLQTQPYGIQGMLKEGHKHFSGVEEAVIKNIDACKQLSTITRTSLGPNGMNKMVINHLDKLFVTSDTATIVNELEVQHPAAKLLVLAGKAQQEEIGDGANLVVSFAGELLQGAEELIRMGLHPSDIIIGYTKAINKLVEILEGLVEEGSDIMDVRNKDEVILRMRAPVASKQYGQEDILCPLIADACIQVCPKNPTNFNVDNVRVAKLLGGGLHNCTTVRGMVLKGDTVGSVKRIEKAKVVVIAGGVDTTATETKGTVLIHSAEQLENYAKTEEAKVEELIKAVADSGAKVIVSGAAVGEMALHFCERYKLMVLKIGSKFELRRFCRTTGAVALLKLGSVVNPDDLGYVDSISVEEIGGSRVTVVRNEQGGNSVTTVLLRASTDSILDDLERAVDDGVNTYKALCRDSRIVPGAAATEIELARKLKEFSFTETGLDQYAIAKFAESFEMIPKTLAENAGLNAMEIISSLYAEHSAGNVKVGIDLEGGACKDVSTLKIWDLFVTKFHALKYAADAVCTVLRVDQIIMSKPAGGPGRRDQPAGMDNED

SEQ ID NO: 6811 - protein, 541 aa, Nicotiana tabacum
  misc_feature (209)..(209): Xaa can be any naturally occurring amino acid
  misc_feature (307)..(307): Xaa can be any naturally occurring amino acid
MQPYGIQGMLKEGNKHLSGLDEAVLKNIDACKQLSAITRTSLGPNGMNKMVINHLDKLFVTNDAATIVNELEVQHPAAKILVLAGKAQQEEIGDGANLTVSFAGELLQGAEELIRMGLHPSEIIIGYNKAINKTIELLDGLVEKGSENMNVTDKNEVISRMKSAVASKQFGLEDVLCPLVAGACIQVCPKNPANFNVDNVRVAKLLGGXLNNSSIVRGMVLKSDAVGSIKRIEKAKVAVFVQGVDTSATETKGTVLIHSAEQLENYAKTEEAKVEELIKAVADSGAKVIVSGGAVGEMALHFCERYXLMVLKISSKFELRRFCRTTGAVALLKLSQPNADDLGYVDSVSVEEIGGVRVTVVRNEEGGNSVSTVVLRGSTDSILDDLERAVDDGVNTYKAMCRDSRIVPGAAATEIELASKLKEFSFKETGLDQYAIAKFAECFEMVPKTLAENAGLNAMEIVSSLYAEHASGNTKVGLNLEKGVCEDISALSIWDLYVTKFFALKYAADAVCTVLRVDQIIMSKPAGGPSRRDQPAGMDED

SEQ ID NO: 6812 - protein, 199 aa, Arabidopsis lyrata
MAIHKLPLLLFLYILLFLNRPVLSDTDEEDILLTGINSYRTTQNLTTLSKNENAECLADEIADQFKNKPCTNDTGSATVPGTEPQFANYPQILAKCHLNVSDTRDGSIMPACVPRLESSLVLTNFTKSQYSMSLNDSKFTGIGIGKEDDWIVVVLTTNTPEGSYSTATPTKQESSGFTFSVGLVSYLIIFMFSFGFFLF

SEQ ID NO: 6813 - protein, 199 aa, Brassica napus
MAINNKLPLLLLLSVVILFLSRTVLSDTDEEDVLFTGINSYRTSQNLTTLNKNKNAECLADELADQFKNKPCTNDTGSATVPGAEPQFSDYPNILAKCHLNVSDTRDGSIMPACVPRLESSLVLTNFTKSQYSMSLNDSKFTGMGIGKEDDWIVVVLTTNTPEGNYSPATKQDSNGFTFSVGLFNYLLAFMLSFCFFLC

SEQ ID NO: 6814 - protein, 199 aa, Brassica oleracea
MAINNKLPLLLLLSVVILFLSRTVLSDTDEEDVLFTGINSYRTSQNLTTLNKNKNAECLADELADQFKNKPCTNDTGSATVPGTEPQFSDYPNILAKCHLNVSDTRDGSIMPACVPRLESSLVLTNFTKSQYSMNLNDSKFTGMGIGKEDDWIVVVLTTNTPEGNYSPATKQESNGCTFSVGLFNYLLAFMVSFCFFLC

SEQ ID NO: 6815 - protein, 199 aa, Brassica rapa
MAINNKLPLLLLLSVVILFLSRTVLSDTDEEDVLFTGINSYRTSQNLTTLNKNKNAECLADELADQFKNKPCTNETGSATVPGTEPQFSDYPNILAKCHLNVSDTRDGSIMPACVPRLESSLVLTNFTKSQYSMSLNDSKFTGMGIGKEDDWIVVVLTTNTPEGNYSPATKQDSNGFTFSVGLFNYLLAFMLSFCFFLC

SEQ ID NO: 6816 - protein, 199 aa, Brassica napus
MAINNKLPLLLLLSVVILFLSRTVLSDTDEEDVLFTGINSYRTSQNLTTLNKNKNAECLADELADQFKNKPCTNETGSATVPGTEPQFSDYPNILAKCHLNVSDTRDGSIMPACVPRLESSLVLTNFTKSQYSMSLNDSKFTGMGIGKEDDWIVVVLTTNTPEGNYSPATKQDSNGFTFSVGLFSYFLAFMLSFCFFLC

SEQ ID NO: 6817 - protein, 199 aa, Brassica napus
MAINNKLPLLLLLSVVILFLSRTVLSDTDEEDVLFTGINSYRTSQNLTTLNKNKNAECLADELADQFKNKPCTNDTGSATVPGTEPQFSDYPNILAKCHLNVSDTRDGSIMPACVPRLESSLVLTNFTKSQYSMNLNDSKFTGMGIGKEDDWIVVVLTTNTPEGNYSPATKQESNGCTFSVGLFNYLLAFMLSFCFFLC

SEQ ID NO: 6818 - protein, 199 aa, Brassica juncea
MAINNKFPLLLLLSVIILALSHHVLSDTDEEDVLFTGINSYRTSQNLTTLNKNKNAECLADEIAENFKNKPCTNDTGSATVPGTEPQFSDYPNILAKCHLNVSDTRDGSIMPACVPRLESSLVLTNFTKSQYSMSLNDSKFTGMGIGKEDDWIVVVLTTNTPEGNYSPATKQDSNGFTFSVSLFNYLLAFMLSFCFFLC

SEQ ID NO: 6819 - protein, 199 aa, Raphanus sativus
MAINNKLPLLLLLSVIILFLSRPVLSDTDEEDVLFTGINSYRTSQNLTTLNKNKNAECLADELADQFKNKPCTNDTGSATVPGTEPQFSDYPNILAKCHLNVSDTRDGSIMPACVPRLESSLVLTNFTKSQYSMSLNDTKYTGMGIGKEDDWIVVVLTTSTPEGNYSPATKQDSSGFIFSIGLFNYLLAFTLSFCFFLC

SEQ ID NO: 6820 - protein, 198 aa, Raphanus sativus
MAINNKLPLLLLSVIILILSRPVVSDTDEEDVLFTGINSYRTSQNLTTLNKNKNAECLADELADQFKNKPCTNDTGSATVPGTEPQFSDYPNILAKCHLNVSDTRDGSIMPACVPRLESSLVLTNFTKSQYSMSLNDSKFTGMGIGKEDDWIVVVLTTSTPEGNYSPATKQDSSGFIFSIGLFNYLLAFTLSFCFFLC

SEQ ID NO: 6821 - protein, 464 aa, Arabidopsis lyrata
MNPSYGGDGKQRPAMYPQVDQSIPDNPFAHTNPYVSSSPYLYPSLSSHNLGPNLFPDHGDASNDQSPSAPPQATEEVLIRVPGAILNLIDKSYSVELACGDFTIVRIIQGGNIVAVLANVGNEIQWPLTTNEVAAKVDGSHYFFSIHPPKEKGQGSGSDSDDEQGKKSKSKSDDDILNYGLTIVSKGQENVLLVLDQVLRDYCCFTEQKMSEKAKETGEEVLGISMVAATSPEELKGERKDVVEGQCAAYWTTLAPNVEDYTHSTAKMIASGSGKLIRGILWCGDVTVERLKKGNEVMKNRLSRAEKEKDVSPETLKRIKRVKKVTQMTEKVATGVLSGVVKVSGFITGSMANSKAGKKLFGLLPGEIVLASLDGFSKICDAVEVAGKNVMSTSSTVTTELVNHRYGTKAAEATNEGLDAAGHAFGTAWVAFKIRKAFNPKNVIKPSSLAKSAVSDLKAKKGSK

SEQ ID NO: 6822 - protein, 451 aa, Brassica napus
SFKIGSFRVNFISINDAVEMNPSHGAADGKQRPAMYPEIDQSIPDNPFAQTNPYVSSSPNLYPPVSSNNQPPSAPPQAVEEILIRVPGAILNLIDKSYSVELACGDLTIVRIVQGENIVAVLANVADEIQWPLTKREVATKVDGSHYFFSIHPPKESGSESDDEILNYGLTIASKGQENVLHGLDQVLRDYCCFAEQRMSEKAKGEEVLGNSMAAATSPEELKGERKDIVEGQCAAYWTTLAPNIEDYSSKTAKMIASGSGQLIRGILWCGDVTVERLKRGNEVMKNRLSRAEKEKDVSPETLRRIKRVKRVTQMTEKVATGVLSGVVKVSGFITGSVANSKAGKKFFGLLPGEIILASLDGFSKICDAVEVAGKNVMSTSSTVTTELVDHKYGTKAAEATNEGLDAAGHAFGTAWVAFKIRKALNPKSVLKPSTLAKSAVSDFKAKKGSK

SEQ ID NO: 6823 - protein, 432 aa, Brassica napus
MNPSHGAADGKQRPAMYPEIDQSIPDNPFAQTNPYVSSSPNLYPPVSSNNQPPSAPPQAVEEILIRVPGAILNLIDKSYSVELACGDLTIVRIVQGENIVAVLANVADEIQWPLTKREVATKVDGSHYFFSIHPPKESGSESDDEILNYGLTIASKGQENVLHGLDQVLRDYCCFAEQRMSEKAKGEEVLGNSMAAATSPEELKGERKDIVEGQCAAYWTTLAPNIEDYSSKTAKMIACGSGQLIRGILWCGDVTVERLKRGNEVMKNRLSRAEKEKDVSPETLRRIKRVKRVTQMTEKVATGVLSGVVKVSGFITGSVANSKAGKKFFGLLPGEIILASLDGFSKICDAVEVAGKNVMSTSSTVTTELVDHKYGTKAAEATNEGLDAAGHAFGTAWVAFKIRKALNPKSVLKPSTLAKSAVSDFKAKKGSK

SEQ ID NO: 6824 - protein, 178 aa, Arabidopsis lyrata
MDKSGGRMVMDEIRSFEKAHLFDLGHPLLNRIADSFVKAAGVGALQAVSREAYFTVVEGAGFDSNNVGPPSEITGNKKHRFPNLRGESSKSLDALVKNTGKESLQWGLAAGLYSGITYGMKEVRGGAHDWRNSAVAGALTGAAMAMTTSERTSHEQVVQSALTGAAISTAANLLSSVF

SEQ ID NO: 6825 - protein, 179 aa, Brassica napus
MEKSGGRKVMDEIRSFEKASLFDLGHPLLNRVADSFVKAAGVGALQAVSREAYFTVVDGTGFDSSSMGPPSEDTGSKKHRFPNLRGENSSKSLEALVKNTGKESLQWGLAAGLYSGITYGMKEARGGAHDWRNSAVAGALTGAAMAMTTSERTSHEQVVQSALTGAAISTAANLLSSVF

SEQ ID NO: 6826 - protein, 179 aa, Raphanus sativus
MEKSGGRKVMDEIRSFEKASLFDLGHPLLNRIADSFVKAAGVGALQAVSREAYFTVVDGTGFDSSSMGPPSEDTGSKKHRFPNLRGENNSKSLEALVKNTGKESLQWGLAAGLYSGITYGMKEARGGAHDWRNSAVAGALTGAAMAMTTSERTSHEQVVQSALTGAAISTAANLLSSVF

SEQ ID NO: 6827 - protein, 179 aa, Brassica napus
MEKSGGRKVMDEIRSFEKASLFDLGHPLLNRVADSFVKAAAVGALQAVSREAYFTVVDGTGFDSSSMGPPSEDTGSKKHRFPNLRGENNSKSLEALVKNTGKESLQWGLAAGLYSGITYGMKEARGGAHDWRNSAVAGALTGAAMAMTTSERTSHEQVVQSALTGAAISTAANLLSSVF

SEQ ID NO: 6828 - protein, 179 aa, Brassica oleracea
MEKSGGRKVMDEIRSFEKASLFDLGHPLLNRVADSFVKAAAVGALQAVSREAYFTVVDGTGFDSSSMGPPSEDTGSKKHRFPNLRGENNSKSLEALVKNTGKESLQWGLAAGLYSGITYGMKEARGGAHDWRNSAVAGALTGAALAMTTSERTSHEQVVQSALTGAAISTAANLLSSVF

SEQ ID NO: 6829 - protein, 178 aa, Raphanus sativus
MDKSGGRKVMDEIRSFEKANLFDLGHPLLNRIADSFVKAAGVGAFQAVSREAYFTVVDGAGFDASNMGPPSENAGSKKHRFPNLRGERSKSLDAFVKNTGKESLQWGLAAGLYSGITFSMKETRGGAHDWRNSAVAGALTGAAMAMTTSERTSHEQVVQSALTGAAISTAANLLSSVF

SEQ ID NO: 6830 - protein, 174 aa, Brassica rapa
METSGGKKITVEIKRFENEKASLFDLGHPLLNSIADSFVKAAGVGALQAVSREAYFTVADGAGSDSSENNGSKQHRFPNLRGESSKSLEALVKNTGKESLQWGLAAGLYSGITYGMKEARGGSHDWRNSVVAGALTGAAMAMTTSERTSHDQVVQSALTGAAISAAANLLSSIF

SEQ ID NO: 6831 - protein, 174 aa, Brassica napus
METSGGKKITVEIKRFENEKASLFDLGHPLLNSIADSFVKAAGVGALQAVSREAYFTVADGAGSDSSENNGSKQHRFPNLRGESSKSLEALVKNTGKESLQWGLAAGLYSGITYGMKEARGGAHDWRNSVVAGALTGAAMAVTTSERTSHDQVVQSALTGAAISAAANLLSSIF

SEQ ID NO: 6832 - protein, 174 aa, Brassica napus
METTGGKKITVEIKRFENEKASLFDLGHPLLNSIADSFVKAAGVGALQAVSREAYFTVVDGAGSDSSENNGSNKLRFPNLRGESSKSLEALVKNTGKESLQWGLAAGLYSGITYGMKEARGGTHDWRNSVVAGALTGAAMAVTTSERTSHDQVVQSALTGAAISAAANLLSSVF

SEQ ID NO: 6833 - protein, 194 aa, Brassica napus
VRNKRDKGKRKMSEERSKRTIETSGGKKITVEIKRFENEKASLFDLGHPLLNSIADSVVKAAGVGALQAVSREAYFTVVDGAGSDSSENNGSNKHRFPNLRGESSKSLEALVKNTGKESLQWGLAAGLYSGITYGMKEARGGTHDWRNSVVAGALTGAAMAVTTSERTSHDQVVQSALTGAAISAAANLLSSVF

SEQ ID NO: 6834 - protein, 174 aa, Brassica oleracea
  misc_feature (62)..(62): Xaa can be any naturally occurring amino acid
  misc_feature (132)..(132): Xaa can be any naturally occurring amino acid
METSGGKKITVEIKRFENEKASLFDLGHPLLNGIADSFVKAAGVGALQAVSREAYFTVVDGXGSDSSENNGSNKLRFPNLRGESSKSLEALVKNTGKESLQWGLAAGLYSGITYGMKEARGGTHDWRNSVVXGALTGAAMAVTTSERTSHDQVVQSALTGAAISAAANLLSSVF

SEQ ID NO: 6835 - protein, 444 aa, Arabidopsis lyrata
MKFLIQSISGRNRSLVRALVSRRYFASSPEELAKKNYANDLSEYNTAVHSVTAQRRHYLLRDVYDDMKLDGVQPTADIFHSFVVGTMKGARLSDAFFFREEMKAMGIAPDVNLYNFLISTCGKCKNGKEAIRVYDEMKRYDVKPNGQTFVCLLNACAVSGQLDLVYAIVRDMTAAGVGLNQFCYAGLITAHLNKQPRPDNLSTKILEFVEQSKGWSAIDSSRKSAEDVMFSISEEELYNIPTADYAHRTRFLQRNLTVYHVAFSALADIKDVKATEALLEMLKKDGKDTDTYCVLQIMRCYLHSQDFENGLKVFEDYMSADKIPAMELYTTLIEGAMTGHTDNGMKIAQDTLVKMNERNFFLDPRTGSNLLLKAAGEKTGGYTVANMIWDLMLARNILPTLAAVEAYYKGLKEREIPEDDPRLMLVTRTYNNLRLKEGTLPNRR

SEQ ID NO: 6836 - protein, 445 aa, Brassica napus
MKFLIQSIAGRNRSLVRALVSRRFFASSSPEELAKRNYANDLSEYNSVVNSVTAQRRHYLLRDVYDDMKLDGVQPTADIFHSFVVGVMKGARLSDAFFFREEMKSMGIAPDVNLYNFLISTCGKCKNGKEAIRVFDEMKRYDVKPNGQTFVCLLNACAVSGHLDLVYAIVRDMTAAGVGLNQFCYAGLITAHLNKEPRPENLSTKILELVEQSKGWSSIDSSRKSAEDMMFSISEEELYNVPTAEYSHRSRFLQRNLTVYHVAFSALADIKDVQATEALLEMLKKDGKNTDTYCVVQIMRCYLHSKDFKNGLKWFQDYMNSDKTPAMELYTTLIEGAMTDYTEEGMKIAQETLVSMNDRNFFLDARTGSNLLLKAAGETTGGYTVANMTWDLMQARNIPQTLASVEAYYKGLKEREIPEDDPRLMLVTRTFNTLKRQQGTFLNRR

SEQ ID NO: 6837 - protein, 445 aa, Brassica napus
MKFLIQSIAGRNRSLVRALVSRRFFASSSPEELAKRNYANDLSEYNSVVNSVTAQRRHYLLRDVYDDMKLDGVQPTADIFHSFVVGVMKGARLSDAFFFREEMKSMGIAPDVNLYNFLISTCGKCKNGKEAIRVFDEMKRYDVKPNGQTFVCLLNACAVSGHLDLVYAIVRDMTAAGVGLNQFCYAGLITAHLNKEPRPENLSTKILELVEQSKGWSSIDSSRKSAEDMMFSISEEELYNVPTAEYSHRSRFLQRNLTVYHVAFSALADIKDVQATEALLEMLKKDGKNTDTYCVIQILRCYLHSKDFQNGVKWFQDYMNSDKTPAMELYTTLIEGAMTDYTEEGMKIAQETLVSMNDRNFFLDARTGSNLLLKAAGEKTGGYTVANMTWDLMQARNIPQTLASVEAYYKGLKEREIPEDDPRLMLVTRTFNTLKRQQGTFLNRR

SEQ ID NO: 6838 - protein, 445 aa, Brassica rapa
MKFLIQSIAGRNRSLVRTLVSRRFFASSSPEELAKRNYANDLSEYNSVVNSVTAQRRHYLLRDVYDDMKLDGVQPTADIFHSFVVGVMKGARLSDAFFFREEMKSMGIAPDVNLYNFLISTCGKCKNGKEAIRVFDEMKRYDVKPNGQTFVCLLNACAVSGHLDLVYAIVRDMTAAGVGLNQFCYAGLITAHLNKEPRPENLSTKILELVEQSKGWSSIDSSRKSAEDMMFSISEEELYNVPTAEYSHRSRFLQRNLTVYHVAFSALADIKDVQATEALLEMLKKDGKNTDTYCVIQIMRCYLHSKDFKNGVKWFQDYMNSDKTPAMELYTTLIEGAMTDYTEEGMKIAQETLVSMNDRNFFLDARTGNNLLLKAAGEKTGGYTVANMTWDLMQARNIPQTLASVEAYYKGLKEREIPEDDPRLMLVTRTFNTLKRQQGTFLNRR

SEQ ID NO: 6839 - protein, 446 aa, Brassica napus
MKFLIQSIAGRNRSLVRALVSRRFFASSSSPEELAKRNYANDLSEYNSVVNSVTAQRRHYLLRDVYDDMKIDGVQPTADIFHSFVVGVMKGARLSDAFFFREEMKSMGIAPDVNLYNFLISTCGKCKNGKEAIRVFDEMKRYDVKPNGQTFVCLLNACAVSGHLDLVYAIVRDMTAAGVGLNQFCYAGLITAHLNKEPRPENLSTKILELVEQSKGWSSIDSSRKSAEDMMFSISEEELYNVPTAEYSHRSRFLQRNLTVYHVAFSALADIKDVQATEALLEMLKKDGKNTDTYCVVQIMRCYLHSKDFKNGLKWFQDYMNSDKTPAMELYTTLIEGAMTDYTEEGMKIAQETLVSMNDRNFFLDARTGSNLLLKAAGETTGGYTVANMTWDLMQARNIPQTLASVEAYYKGLKEREIPEDDPRLMLVTRTFNTLKRQQGTFLNRR

SEQ ID NO: 6840 - protein, 446 aa, Brassica napus
MKFLIQSIAGRNRSLVRALVSRRFFASSSSPEELAKRNYANDLSEYNSVVNSVTAQRRHYLLRDVYDDMKIDGVQPTADIFHSFVVGVMKGARLSDAFFFREEMKSMGIAPDVNLYNFLISTCGKCKNGKEAIRVFDEMKRYDVKPNGQTFVCLLNACAVSGHLDLVYAIVRDMTAAGVGLNQFCYAGLITAHLNKEPRPENLSTKILELVEQSKGWSSIDSSRKSAEDMMFSISEEELYNVPTAEYSHRSRFLQRNLTVYHVAFSALADIKDVQATEALLEMLKKDGKNTDTYCVIQILRCYLHSKDFQNGVKWFQDYMNSDKTPAMELYTTLIEGAMTDYTEEGMKIAQETLVSMNDRNFFLDARTGSNLLLKAAGEKTGGYTVANMTWDLMQARNIPQTLASVEAYYKGLKEREIPEDDPRLMLVTRTFNTLKRQQGTFLNRR

SEQ ID NO: 6841 - protein, 447 aa, Raphanus sativus
MKFLIQSIAGRNRSLVRALVSRRFFASSSSSPEELAKRNYANDLSEYNSVVNSVTAQRRHYLLRDVYDDMKLDGVQPTADIFHSFVVGVMKGARLSDAFFFREEMKSMGISPDVNLYNFLISTCGKCKNGKEAIRVFEEMKRYDVKPNGQTFVCLLNACAVSGQLDLVYAIVRDMTAAGVGLNQFCYAGLITAHLNKEPRPENLSTKILELVEQSKGWSSIDSSRKSAEDMMFNISEEELYNVPTAEYSHRSRFLQRNLTVYHVAFSALADIKDVQATEALLEMLKKDGKNTDTYCVIQIMRCYLHSKDFKNGLKWFGDYMNSDKTPAMELYTTLIEGAMTDYTEEGMKIAQETLVSMNDRNFFLDARTGSNLLLKAAGEKTGGYTVANMTWDLMQARNIPQTLASVEAYYKGLKEREIPEDDPRLMLVTRTFNTLKRQQGTFPNRR

SEQ ID NO: 6842 - protein, 540 aa, Arabidopsis lyrata
MECSATRPKLYPTVDTSTTVAPLPNSSSSSCTNNNLYPSIDVNDLVNNIFPDPTASDSASAPPMATEEVILTIHGAMLHLIDKSYSVELACGDLEILRLVQGDITVAVFARVADEIQWPLTKDEPAVKVDESHYFFSLRPVKESGSSDHSINEAENEMLNYGLTIASKGQEPLLEKLDKILADYSSFTAEENQKEENVLDLTAAKETSPEELKGKRKKMVEKQCTAYWTTLAPNVEDYSGVAAKLIAAGSGQLIKGILWCGDLTMDRLMWGNDFMKKKLSKAEKERQVSPGTLKRLKRVKKMTKMTEKVANGVLSGVVKVSGFFSSSVINSKAGQKLFGLLPGEMVLATLDGFNKVCDAVEVAGRNVMKTSSNVATEIVDHKYGAKTAQATNEGLSAAGHAIGTAWTVFKIRQALNPKSAMKPSSLAKTAIKTAAKEKKKGKKSSKLLGIQADYGFFNVDEKKQAAADVLFSYSKFAMACIGNQTRPTDMRLHLMKEISGLPTSLKRRESSRAATSPDPVGESSSSGTARLDKTDSFRAL

SEQ ID NO: 6843 - protein, 287 aa, Arabidopsis lyrata
MTGSQGEETHQPKIVDQEQPKTVETEHQPQPQPEPSSSSPDQKKWGTHVMGAPAAPVAHPDNQQAAAWVAGDNQQTQYQPYVIYSPVENHNNNPLEPVIGMFHTWSRKAETVARNLWHNLKTGPSMSETAWGKVNLTAKAITEGGFESLFRQIFGTEPNEKLKKTFACYLSTTTGPVAGTLYLSNARVAFCSDRPLYFTAPSGQESWSYYRVVIPLGNVATVNPVVVKETPPEKYIQVTTVDGHDFWFMGFVNYEKATHHLLTSVSDSQTAHGSVSDSQTAHGSVSV

SEQ ID NO: 6844 - protein, 275 aa, Brassica rapa
MTGSQEETHKPQIVDQEHPKTLETEDPRQEQPSSSSPDKKKWGTHVMGAPAEPVAHPDNQQAAAWVAGDNRQMPYQPYIVYSPVEHPPSNNPLEPVIGMFHTWSRKAETVARNIWHNLKTGPSMQETAWGKANLTVKAITKGGFESLFRQIFGTDPNEKLKKTFACYLSTTTGPVAGTLYLSNVRVAFCSDRPLFFTAPSGQEAWSYYRVVVPLVNIATVNPVVVKEDPPEKYIQLTTVDGHDFWFMGFVNYEKASHHLLTSVSDSQTARTSASG

SEQ ID NO: 6845 - protein, 272 aa, Brassica napus
MTGSQEETHKPQIVDQEHPKTVETEAQQPSSSSPDKKKWGTHVMGAPAEPVAHPDNQQAAAWVAGDNRQMPYQPYIVYSPVEHPPSNNPLEPVIGMFHTWSRKAETVARNIWHNLKTGPSMEETVWGKANLTVKAITKGGFESLFRQIFGTDPNEKLKKTFACYLSTTTGPVAGTLYLSNVRVAFCSDRPLFFTAPSGQEAWSYYRVVVPLVNIATVNPVVVKEDPPEKYIQLTTVDGHDFWFMGFVNYEKASHHLLTSVSDSQTARTSASG

SEQ ID NO: 6846 - protein, 275 aa, Brassica napus
MTGSQEETHKPQIVDQEHPKTLETEDPPQEQRSSSSPDKKKWGTHVMGAPAEPVAHPDNQQAAAWVAGDNRQMPYQPYIVYSPVEHPPSNNPLEPVIGMFHTWSRKAETVARNIWHNLKTGPSMQETAWGKANLTVKAITKGGFESLFRQIFGTDPNEKLKKTFACYLSTTTGPVAGTLYLSNVRVAFCSDRPLFFTAPSGQEAWSYYRVVVPLVNIATVNPVVVKEDPPEKYIQLTTVDGHDFWFMGFVNYEKASHHLLTSVSDSQTARTSASG

SEQ ID NO: 6847 - protein, 275 aa, Brassica oleracea
  misc_feature (127)..(127): Xaa can be any naturally occurring amino acid
  misc_feature (133)..(133): Xaa can be any naturally occurring amino acid
MTGSQEETHKPQIVDQEHPKTLETEDPRQEQPSSSSPDKKKWGTHVMGAPAEPVAHPDNQQAAAWVAGDNRQMPYQPYIVYSPVEHPPSNNPLEPVIGMFHTWSRKAETVARNIWHNLKTGPSMQEXAWGKAXLTVKAITKGGFESLFRQIFGTDPNEKLKKTFACYLSTTTGPVAGTLYLSNVRVAFCSDRPLFFTAPSGQEAWSYYRVVVPLVNIATVNPVVVKEDPPEKYIQLTTVDGHDFWFMGFVNYEKASHHLLTSVSDSQTARTSASG

SEQ ID NO: 6848 - protein, 279 aa, Raphanus sativus
MTGSQEETHQPHTVDQEHPKTVETEHQQQQQEEHPSSSSSPDQKKWGTHVMGAPAAPVAHPDNQQAAAWVAGDNRQMPHQPYIVYSPVEHPPSNNPLEPVIGMFHTWSRKAETVARNIWHNLKTGPSMPETAWGKVNLTAKAITKGGFESLFRQIFGTDPNEKLKKTFACYLSTTTGPVAGTLYLSNVRVAFCSDRPLFFTAPSGQEAWSYYRVVVPLVNIATVNPVVVKEDPPEKYIQVTTVDGHDFWFMGFVNYEKASHHLLTSVSDSHTAPTYASG

SEQ ID NO: 6849 - protein, 277 aa, Raphanus sativus
  misc_feature (9)..(9): Xaa can be any naturally occurring amino acid
  misc_feature (17)..(17): Xaa can be any naturally occurring amino acid
  misc_feature (185)..(185): Xaa can be any naturally occurring amino acid
MTGSQEETXQPHTVDQXHPKTVETEHQQQQQEHPSSSSSPDQKKWGTHVMGAPAAPVAHPDNQQAAAWVAGDNQQMPHQPYIVYSPVEHPPSNNPLEPVIGMFHTWSRKAETVARNIWHNLKTGPSMPETAWGKVNLTAKAITKGGFESLFRQIFGTDPNEKLKKTFACYLSTTTGPVAGTLYLXNVRVAFCSDRPLFFTAPSGQKLEYYRVVVPLVNIATVNPVVVKEDPPEKYIQVTTVDGHDFWFMGFVNYEKASHHLLTSVSDSHTARTSASG

SEQ ID NO: 6850 - protein, 186 aa, Arabidopsis lyrata
MTEKKEMQVVKGLDLERYMGRWYEIASFPSRFQPKNGVDTRATYTLNPDGTVHVLNETWSNGKRGFIEGSAYKADPKSDEAKLKVKFYVPPFLPIIPVTGDYWVLYIDPDYQHALIGQPSRSYLWILSRTAHMEEETYKQLVEKAVEEGYDIGKLHKTPQSDTPPESNTAPEDSKGIWWFKSLFGK

SEQ ID NO: 6851 - protein, 199 aa, Brassica napus
MKITALLVLKAAPETSDPVILANASDVSHFGYFQRSSVKEFVVFVGRTVASRTPPSQRQSVQHEEYKVHAYNRNGLCAVGFMDDHYPVRSAFSLLNQVIDEYQKSFGEAWRSAKEDSSQPWPYLAEALTKFQDPAEADKLLKIQRELDETKIILHKTIDSVLARGEKLDSLVEKSSDLSMASQMFYKQAKKTNSCCTIL

SEQ ID NO: 6852 - protein, 185 aa, Unknown
  Sequence found in Organisms: Brassica napus, Zea mays
MTSTEMKAVKGLDLERYMGRWYEIASFPSRFQPKDGVDTRATYTLNPDGTVHVLNETWNGGKRGFIQGSAYKADPKSDEAKLKVKFFVPPFLPVIPVTGDYWVLYIDPEYQHAVIGQPSRSYLWILSRTAHMEEETYKQLVEKAVEEGYDVSKLHKTPQSDTPPESNTAPDDTKGVWWLKSIFGK

SEQ ID NO: 6853 - protein, 186 aa, Raphanus sativus
MTEKKEMNVVKGLDLERYMGRWYEIASFPSRFQPKNGADTRATYTLNPDGTVHVLNETWDGGKRGFIQGSAYKADPKSDEAKLKVKFFVPPFLPVIPVTGDYWVLYVDPEYQHAVIGQPSRSYLWILSRTAHVEEETYKQLVEKAVEEGYDVSKLHRTPQSDTPPESNTAPDDTKGVWWIKSILGK

SEQ ID NO: 6854 - protein, 186 aa, Raphanus sativus
MTEKKEMNVVKGLDLERYMGRWYEIASFPSRFQPKNGADTRATYTLNPDGTVHVLNETWDGGKRGFIQGSAYKADPKSDEAKLKVKFFVPPFLPVIPVTGDYWVLYVDPEYQHAVIGQPSKSYLWILSRTAHVEEETYKQLVEKAVEEGYDVSKLHRTPQSDTPPESNTAPDDTKGVWWIKSILGK

SEQ ID NO: 6855 - protein, 187 aa, Brassica napus
MTTQKKEMEVVKDLDLERYMGRWYEIASFPSIFQPKNGVDTRATYTLNPDGTVHVLNETWNGGKRAFIQGSAYKTDPKSDEAKFKVKFYVPPFLPIIPVTGDYWVLYIDPDYQHAVIGQPSRSYLWILSRTAHVEEETYKQLLEKAVEEGYDVSKLHKTPQSDTPPESNAAPDDTKGIWWFKSMFGK

SEQ ID NO: 6856 - protein, 187 aa, Unknown
  Sequence found in Organisms: Brassica napus, Brassica rapa
MTTQKKEMEVVKDLDLERYMGRWYEIASFPSIFQPKNGVDTRATYTLNPDGTVHVLNETWNGGKRAFIQGSAYKTDPKSDEAKFKVKFYVPPFLPIIPVTGDYWVLYIDPEYQHAVIGQPSRSYLWILSRTAHVEEETYKQLLQKAVEEGYDVSKLHKTPQSDTPPESNAAPDDTKGVWWFKSMFGK

SEQ ID NO: 6857 - protein, 187 aa, Raphanus sativus
  misc_feature (77)..(77): Xaa can be any naturally occurring amino acid
MTEKKEMNVVKGLDLERYMGRWYEIASFPSRFQPKNGADTRATYTLNPEGTVHVLNETWDGGKRGFIQGSAYKADPXSDEAKLKVKFFVPPFLPVIPVTGDYWVLYVDPEYQHAVIGQPSKSYLWILSRTAHVEEETYKQLVEKAVEEGGYDVSKLHRTPQSDTPPESNTAPDDTKGVWWIKSILGK

SEQ ID NO: 6858 - protein, 187 aa, Raphanus sativus
MTTEKKVMEVVKNLDLERYMGRWYEIASFPSIFQPKNGVDTRATYTLNPDGTVHVLNETWNGGKRAFIQGSAYKTDPKSDEAKFKVKFYVPPFLPIIPVTGDYWVLYIDPEYQHAIIGQGSRSSLWILSRTAHMEEETYKALVEKAVEEGYDVSKLHKTPQSDTPPGSNAAPDDTKGVWWFKSMFGK

SEQ ID NO: 6859 - protein, 179 aa, Brassica juncea
RDGSGERSRLGEVHGPLVASFPSRFQPKNGADTRATYTLNPDGTVHVLNETWNGGKRGFIQGSAYKADPKSDEAKLKVKFFVPPFLPVIPVTGDYWVLYIDPEYQHAVIGQPSRSYLWILSRMAHVEEETYKQLVEKAVEEGYDVSKLHKTPQSDTPPESNTAPDDTKGVWWLKSIFGK

SEQ ID NO: 6860 - protein, 187 aa, Brassica juncea
MATEKKEMEVVKGLDLERYMGRWYEIASFPSRFQPKDGVDTRATYTLNPDGTVKVLNETWNGGKRGFIQGSAFKTDPKSDEAKFKVRFYLPPFLPIIPVTGDYWVLYIDPEYQHAVIGQPSRSYLWILSRTAHMEEETYKELVEKAVEQGYDVSKLHKTPQSDTPPESNAAPDDTKGIWWLKSIFGK

SEQ ID NO: 6861 - protein, 187 aa, Brassica nigra
MATEKKEMEVVKGLDLERYMGRWYEIASFPSRFQPKDGVDTRATYTLNPDGTVKVLNETWNGGKRGFIQGSAFKTDPKSDEAKFKVRFYLPPFLPIIPVTGDYWVLYIDPEYQHAVIGQPSRSYLWILSRTAHVEEETYKELVEKAVEQGYDVSKLHKTPQSDTPPESNAAPDDTKGIWWLKSIFGK

SEQ ID NO: 6862 - protein, 187 aa, Unknown
  Sequence found in Organisms: Brassica napus, Brassica rapa
MTTEKKEMEVVKGLDLERYMGRWYEIASFPSRFQPKNGADTRATYTLNPDGTVKVLNETWDGGKRGFIQGSAFKTDPKSDEAKFKVRFYVPPFLPIIPVTGDYWVLYIDPEYQHAVIGQPSRSYLWILSRTAHVEEETYKQLVEKAVEQGYDVSKLHKTAQSDTPPESDAAPDDTKGIWWLKSIFGK

SEQ ID NO: 6863 - protein, 187 aa, Thellungiella halophila
MTTEKKEMQVVKGLDLERYMGRWYEIASFPSLFQPKNGVDTRATYTLNPDGTVHVLNETWNGGKRAFIQGSAYKTDPKSDEAKFKVKLYVPPFLPIIPVTGDYWVLYIDPDYQHAVIGQGSRSYLWILSRTAHMEEDTYNQLVQKAVDEGYDVSKLHKTPQSDTPPESDAAPNDTKGVWWLKSIFGK

SEQ ID NO: 6864 - protein, 187 aa, Raphanus sativus
MATEKKEMEVVKGLDLERYMGRWYEIASFPSRFQPKDGVDTRATYSLNPDGTVKVLNETWNGGKRGFIQGSAFKTDPKSDEAKFKVRFYLPPFLPIIPVTGDYWVLYIDPEYQHAVIGQPSRSYLWILSRTAHVEEETYKELVEKAVEQGYDVSKLHKTPQSDTPPESNAAPDDTKGIWWLKSIFGK

SEQ ID NO: 6865 - protein, 196 aa, Brassica rapa
  misc_feature (5)..(5): Xaa can be any naturally occurring amino acid
  misc_feature (120)..(120): Xaa can be any naturally occurring amino acid
  misc_feature (140)..(140): Xaa can be any naturally occurring amino acid
RNRKXEEKMTSTEKKEMKAVKGLDLERYMGRWYEIASFPSRFQPKDGVDTRATYTLNPDGTVHVLNETWNGGKRGFIQGSAYKADPKSDEAKLKVKFFVPPFLPVIPVTGDYWVLYIDPXYQHAVIGQPSRSYLWILSRXAHMEEETYKQLVEKAVEEGYDVSKLHKTPQSDTPPESNTAPDDTKGVWWLKSIFGK

SEQ ID NO: 6866 - protein, 187 aa, Brassica juncea
  misc_feature (2)..(2): Xaa can be any naturally occurring amino acid
  misc_feature (80)..(80): Xaa can be any naturally occurring amino acid
  misc_feature (90)..(90): Xaa can be any naturally occurring amino acid
MXTEKKEMEVVKGLDLERYMGRWYEIASFPSRFQPKDGVDTRATYTLNPDGTVKVLNETWNGGKRGFIQGSAFKTDPKSXEAKFKVRFYXPPFLPIIPVTGDYWVLYIDPEYQHAVIGQPSRSYLWILSRTAHVEEETYNQLLEKAVEQGYDVSKLHKTPQSDTPPESNAAPDDTKGIWWLKSIFGK

SEQ ID NO: 6867 - protein, 187 aa, Unknown
  Sequence found in Organisms: Brassica napus, Brassica oleracea
MTTEKKEMEVVKGLDLERYMGRWYEVASFPSRFQPKNGADTRATYTLNPDGTVKVLNETWDGGKRGFIQGSAFKTDPKSDEAKFKVRFYVPPFLPIIPVTGDYWVLYIDPEYQHAVIGQPSRSYLWILSRTAHVEEETYKQLVEKAVEQGYDVSKLRKTAQSDTPPESDAAPDDTKGIWWIKSIFGK

SEQ ID NO: 6868 - protein, 179 aa, Brassica juncea
EVVKNLDLERYMGRWYEIASFPSIFQPKNGVDTRATYALNPDGTVHVLNETWNGGKRAFIQGSAYKTDPKSDEAKFKVKFYVPPFLPIIPVTGDYWVLYIDPEYQHAVIGQPSRSYLWILSRTAHVEEETYKQLLQKAVEEGYDVSKLHKTPQSDTPPESNAAPDDTKGVWWFKSMFGK

SEQ ID NO: 6869 - protein, 187 aa, Raphanus sativus
MATEKKEMEVVKGLDLERYMGRWYEIASFPSRFQPKDGVDTRATYSLNPDGTVKVLNETWNGGKRGFIQGSAFKTDPKSDEAKFKVRFYLPPFLPIIPVTGDYWVLYIDPEYQHAVIGQPSRSYLWILSRTAHVEEETYKELVEKAVEQGYDVNKLHKTPQSDTPPEANAAPDDTKGIWWLKSIFGK

SEQ ID NO: 6870 - protein, 173 aa, Brassica oleracea
MTSTEMKAVKGLDLERYMGRWYEIASFPSRFQPKDGVDTRATYTLNPDGTVHVLNETWNGGKRGFIQGSAYKADPKSDEAKLKVKFFVPPFLPVIPVTGDYWVLYIDPEYQHAVIGQPSRSYLWILSRTAHMEEETYKQLVEKAVEEGYDVSKLHKTPQSDTPPESNTAPDDT

SEQ ID NO: 6871 - protein, 55 aa, Raphanus sativus
KKEMEVVKGLDLERYMGRWYEIASFPSRFQPKDCVDTRATYSLNPDGTVKVLNET

SEQ ID NO: 6872 - protein, 185 aa, Cleome spinosa
MGEKEMEVVKGLDVERYMGRWYEIASFPSRFQPKNGENTRATYSLNPDGTVNVLNETWSDGKRGFIQGTAYKADPKSEEAKLKVRFYVPPFLPIIPITGDYWVLYIDPEYQHALIGQPSRRYLWILSRRPQMEEETYKEMVRRAVEEGYDVSKLHKTPQADPPPEPDVSPTDSKGIWWIKSILGK

SEQ ID NO: 6873 - protein, 172 aa, Brassica juncea
LERYMGRWYEIASFPSIFQPKNGVDTRATYALNPDGTVHVLNETWNGGKRAFIQGSAYKTDPKSDEAKFKVKFYVPPFLPIIPVTGDYWVLYIDPEYQHAVIGQPSRSYLWILSRTAHVEEETYKQLLQKAVEEGYDVSKLHKTPQSDTPPESNAAPDDTKGVWWFKSMFGK

SEQ ID NO: 6874 - protein, 182 aa, Raphanus sativus
  misc_feature (4)..(5): Xaa can be any naturally occurring amino acid
MTTXXKEMEVVKNLDLERYMGRWYEIASFPSFFQPKNGVDTRATYSLNPDGTVHVLNEVWNGGKRAFIEGSAYKTDPKSDEAKFKVKFYVPPFLPIIPVTGDYWVLYIDPEYQHAVIGQATRSYLWILSRTAHVEEETYKALVEKAVEEGYDVSKLHKTPQSDTPPESDAATDDTRVFGVKY

SEQ ID NO: 6875 - protein, 206 aa, Brassica napus
YQTSKATKYLRNRKLEEKMTSTEKKEMKAVKGLDLERYMGRWYEIASFPSRFQPKDGVDTRATYTLNPDGTVHVLNETWNGGKRGFIQGSAYKADPKSDEAKLKVKFFVPPFLPVIPVTGDYWVLYIDPQYQHAVIGQPSRSYLWILSRTAHMEEETYKQLVEKAVEEGYDVSKLHKTPQSDTPPESNTAPDDTKGVWWLKSIFGK

SEQ ID NO: 6876 - protein, 185 aa, Orobanche aegyptiaca
MATKEMDVVKGLNVERYMGRWYEIASFPSRFQPKNGTDTRASYTLNPDGTVHVLNETWSDGKRGFIEGTAWKADPKSDEAKLKVRFYVPPFLPVIPVTGDYWVLHIDGDYQHALIGQPSRRYLWILSRQPQLDDEMYVQLVEKAKEVGYDVSKLHKTPHSGTPPDSEDAPNDTKGIWWIKSIFGR

SEQ ID NO: 6877 - protein, 282 aa, Leymus cinereus x Leymus triticoides
  misc_feature (34)..(34): Xaa can be any naturally occurring amino acid
  misc_feature (36)..(36): Xaa can be any naturally occurring amino acid
  misc_feature (48)..(49): Xaa can be any naturally occurring amino acid
  misc_feature (52)..(53): Xaa can be any naturally occurring amino acid
VPVHFAPPLPSPRLPPHPRKPYLRRLRHRRARCXGXRRASTSRRGPPXXPAXXRRRGGYPGMTESPELRWALIRKIYVILSLQLLLTAVVAAVVVKVRAIPHFFVSSNAGLGLYIFLIIFPFIVLCPLYFYRQKHPVNLLLLGVFTVAISFAVGMTCAFTSGKVILEAAILTTVVVFSLTAYTFWAARRGQDFSFLGPFLFASLIMLLVFGFIQILFPLGKLSHMIYGALAALIFSGYIVYDTDNIIKRYTYDEYVWAAVSLYLDVINLFLALLTLFRAGDS

SEQ ID NO: 6878 - protein, 251 aa, Triticum aestivum
MMGYQKGVDIEAGTSGGTGTAAPTRGLYPGMTESPELRWALIRKIYVILSLQLLLTAVVAAVVVKVRAIPHFFVSSSAGLGLYIFLIIFPFIVLCPLYFYRQKHPVNLLLLGVFTVAISFAVGMTCAFTSGKVILEAAILTTVVVFSLTAYTFWAAKRGQDFSFLGPFLFASLIMLLVFGFIQILFPMGKLSHMIYGALAALIFSGYIVYDTDNIIKRYTYDEYVWAAVSLYLDVINLFLALLTLFRAGDS

SEQ ID NO: 6879 - protein, 252 aa, Triticum aestivum
MMGYQKGVDIEAGTSGGGTGTTAPTRGLYPGMTESPELRWALIRKIYVILSLQLLLTAVVAAVVVKVRAIPHFFVSSSAGLGLYIFLIIFPFIVLCPLYFYRQKHPVNLLLLGVFTVAISFAVGMTCAFTSGKVILEAAILTTVVVFSLTAYTFWAAKRGQDFSFLGPFLFASLIMLLVFGFIQILFPMGKLSHMIYGALAALIFSGYIVYDTDNIIKRYTYDEYVWAAVSLYLDVINLFLALLTLFRAGDS

SEQ ID NO: 6880 - protein, 253 aa, Hordeum vulgare
MFGYQKGVDVEAGPSGGTGGGGAAAPTRGLYPGMTESPEMRWALIRKIYVILSLQLLLTAVVAAVVVKVRAIPHFFVSSSAGLGLYIFLIIFPFIVLCPLYFYRQKHPVNLLLLGVFTVAISFAVGMTCAFTSGKVILEAAILTTVVVFSLTAYTFWAARRGQDFSFLGPFLFASLIMLLVFGFIQILFPMGKLSHMIYGALAALIFSGYIVYDTDNIIKRYTYDEYVWAAVSLYLDVINLFLALLTLFRAGD

SEQ ID NO: 6881 - protein, 251 aa, Brachypodium distachyon
MFGYHQKGGDIEAGTSGGAGAAPTRGLYPGMTESPELRWALIRKIYTILSLQLLLTAAVAAVVVKVRAISHFFVSSNAGLGLYIFLVIFPFIVLCPLYFYRQKHPVNLLLLGIFTVAISFAVGMTCAFTSGKVILEAAILTAVVVVSLTAYTFWAAKRGQDFSFLGPFLFASLIVLIVFAFIQILFPMGKLSHMIYGGLAALIFSGYIVYDTDNIIKRFTYDEYVWAAVSLYLDVINLFMALITLFSAADS

SEQ ID NO: 6882 - protein, 249 aa, Avena sativa
MFAYQKGGDIEAGTSGGAGAAPTRGLYPGMTESPELRWALIRKIYVILSLQLLLTAVVAAVVIKVRAIPHFFVSTNAGFGLYIFLIIFPFIVLCPLYFYRQKHPVNLLLLAVFTIAISFAVGMTCAFTSGKVILEAAILTTAVVFSLTAYTFWAARRGQDFSFLGPFLFASLIMLLVFGFIQILFPLGKLSHMIYGALAALIFSGYIVYDTDNIIKRFTYDEYVWAAASLYLDVINLFLALLTLFRAGD

SEQ ID NO: 6883 - protein, 170 aa, Saccharum officinarum
MGAAESVPETSIHEFTVKDCNGKEVNLETYKGKVLLVVNVASKCGFTEVNYTQLTELYQKYRDKDFEILAFPCNQFLRQEPGSNEQIKDFACTRFKAEYPVFQKVRVNGPDAAPVYKFLKASKPGLFGSARIKWNFTKFLVDKNGKVIERYGTSTAPMSIEKDIQKALEE

SEQ ID NO: 6884 - protein, 170 aa, Zea mays
MGAAESVPETSIHEFTVKDCNGKEVSLETYKGKVLLVVNVASKCGFTETNYTQLTELYQKYRDKDFEILAFPCNQFLRQEPGTDQQIQDFACTRFKAEYPVFQKVRVNGPDAAPVYKFLKASKPGLFGSSRIKWNFTKFLVDKDGKVIERYGTSTAPMAIEKDIQKALEE

SEQ ID NO: 6885 - protein, 169 aa, Cynodon dactylon
MGAAESVPETSIHEFTVKDCNGKEVSLETYKGKVLLVVNVASKCGFTETNYTQLTELYQKYRDKDFEILAFPCNQFLRQEPGTPEQIKDFACTRFKAEYPVFQKVRVNGPDAAPVYKFLKASKPGLFGSRIKWNFTKFLVGKDGKVIERYATSTAPMSIEKDIQKALEE

SEQ ID NO: 6886 - protein, 169 aa, Panicum virgatum
MGAVESVPETSIHEFTVKDCNGKEVSLETYKGKVLLVVNVASKCGFTETNYTQLTELYQKYRDKDFEILAFPCNQFLRQEPGTAEQAKDFACTRFKAEYPVFQKVRVNGPDAAPVYKFLKASKPGLFGSRIKWNFTKFLVDKNGKVIERYATSTAPMSIEKDIQKALEE

SEQ ID NO: 6887 - protein, 60 aa, Pennisetum glaucum
KQRTREKSNQERDSRELRPVGKGRGGEGRGGREEEEPGRPSPCRRPPYTNSPLRIATVRK

SEQ ID NO: 6888 - protein, 169 aa, Panicum virgatum
MGAVESVPETSIHEFTVKDCNGKEVSLETYKGKVLLVVNVASKCGFTETNYTQLTELYQKYRDKDFEILAFPCNQFLRQEPGTAEQAKDFACTRFKAQYPVFQKVRVNGPDAAPVYKFLKASKPGLFGSRIKWNFTKFLVDKNGKVIERYSTSTAPMSIEKDIQKALEE

SEQ ID NO: 6889 - protein, 195 aa, Avena sativa
MGAAESVPETSLHEFTVKDCNGKEVCLETYKGKVLVVVNVASKCGFTETNYTQLTELYQKYREKDFEILAFPCNQFLRQEPGSDQQIKDFACTRFKAEYPVFQKVRVNGPDAAPLYKFLKASKPGLFGSRIKWNFTKFLVDKNGKVINRYGTATAPFSLEKDILKALEEEHIPPLSNPQEAVEEEQKEEQKEEEK

SEQ ID NO: 6890 - protein, 198 aa, Pseudoroegneria spicata
  misc_feature (186)..(186): Xaa can be any naturally occurring amino acid
MGAAESVPETSVHEFTVKDCNGKEVCLDTYKGKVLLIVNVASKCGFTETNYTQLTELYQKYREKDFEILAFPCNQFLRQEPGSDQQIQDFACTRFKAEYPVFQKVRVNGPDAAPLYKFLKASKPGLFGSRIKWNFTKFLVDKNGKVINRYATATTPFSFEKDIQKALEEEPSDSQTKREEEPSDSXTKKEEEPSDSQK

SEQ ID NO: 6891 - protein, 187 aa, Triticum aestivum
MGASESVPETSVHEFTVKDCNGKEVCLDTYKGKVLLIVNVASKCGFTETNYTQLTELYQKYREKDFEILAFPCNQFLRQEPGSDQQIQDFACTRFKAEYPVFQKVRVNGPDAAPLYKFLKASKPGLFGSRIKWNFTKFLVDKNGKVINRYATATTPFSFEKDIQKALEEEPSDSQTKKEEESSDSQK

SEQ ID NO: 6892 - protein, 187 aa, Triticum aestivum
MGASESVPETSVHEFTVKDCNGKEVCLDTYKGKVLLIVNVASKCGFTETNYTQLTELYQKYREKDFEILAFPCNQFLRQEPGSDQQIQDFACTRFKAEYPVFQKVRVNGPDAAPLYKFLKASKPGLFGSRIKWNFTKFLVDKNGKVINRYATATTPFSFEKDIQKALEEEPSESQTKKEEESSDSQK

SEQ ID NO: 6893 - protein, 169 aa, Oryza sativa
MGAAESVPETSIHEFTVKDCNGKEVSLEMYKGKVLIVVNVASKCGFTETNYTQLTELYQKHRDKDFEILAFPCNQFLRQEPGSDQQIKDFACTRFKAEYPVFQKVRVNGPDAAPLYKFLKASKPGLFGSRIKWNFTKFLIDKNGKVINRYSTATSPLSFEKDILKALED

SEQ ID NO: 6894 - protein, 187 aa, Triticum aestivum
MGASESVLETSVHEFTVKDCNGKEVCLDTYKGKVLLIVNVASKCGFTETNYTQLTELYQKYREKDFEILAFPCNQFLRQEPGSDQQIQDFACTRFKAEYPVFQKVRVNGPDAAPLYKFLKANKPGLFGSRIKWNFTKFLVDKNGKVINRYATATTPFSFEKDIQKALEEEPSDSQTKKEEESSDSQK

SEQ ID NO: 6895 - protein, 178 aa, Festuca arundinacea
MGAAESVPETSLHEFTVKDCNGKEVCLETYKGKVLLVVNVASKCGFTETNYTQLTELYQKYREKDFEILAFPCNQFLRQEPGSDQQIKDFACTRFKAEYPVFQKVRVNGPDAAPLYKFLKASKPGLFGSRIKWNFTKFLVDKNGKVINRYATATTPFSFEKDIQKALEGEHIPARSGS

SEQ ID NO: 6896 - protein, 198 aa, Brachypodium distachyon
MGATESVPETSVHEFTVKDCNGKEVCLEMYKGKVLLIVNVASKCGFTETNYTQLTDLYQKHRDKDFEILAFPCNQFLRQEPGSDQQIKDFACQRFKAEYPVFQKVRVNGPDAAPLYKFLKASKPGLFGSRIKWNFTKFLVDKNGKVINRYATATTPFAFEKDILKALEEVPNLQKDTPKASEEVPDLLKDTPKAPESE

SEQ ID NO: 6897 - protein, 176 aa, Hordeum vulgare
MGAAESVPETSVHEFTVKDCNGKEVCLDTYKGKVLLIVNVASKCGFTETNYTQLTELYQKYREKDFEILAFPCNQFLRQEPGSDQQIQDFACTRFKAEYPVFQKVRVNGPDAAPLYKFLKASKPGLFGSRIKWNFTKFLVDKNGKVINRYATATTPFSFEKDIQKALEEEPADSQK

SEQ ID NO: 6898 - protein, 176 aa, Leymus cinereus x Leymus triticoides
MGAAESVPETSVHEFTVKDCNGKEVCLDTYKGKVLLIVNVASKCGFTETNYTQLTELYQKYREKDFEILAFPCNQFLRQEPGSDQQIKDFACTRFKAEYPVFQKVRVNGPDAVPLYKFLKASKPGLFGSRIKWNFTKFLVDKNGKVLNRYATATTPFSFEKDIQKALEEEPSDSQK

SEQ ID NO: 6899 - protein, 158 aa, Secale cereale
MGAAESVPETSVHEFTVKDCNGKEVCLDTYKGKVLLIVNVASKCGFTETNYTQLTELYQKYREKDFEILAFPCNQFLRQEPGSDQQIQDFACTRFKAEYPVFQKVRVNGPDAAPLYKFLKASKPGLFGSRIKWNFTKFLVDKNGKVINRYATATTPFS

SEQ ID NO: 6900 - protein, 187 aa, Avena sativa
MGAAESVPETSIHEFTVKDCNGKEVCLETYKGKVLLVVNVASKCGFTETNYTQLTELYQKYREKDFEILAFPCNQFLRQEPGSDQQIKDFACTRFKAEYPVFQKVRVNGPDAAPLYKFLKASKPGLFGSRIKWNFTKFLVDKNGKVLNRYATATAPFSFEKDILKALEEEHIPPVSNSQEALEEEQK

SEQ ID NO: 6901 - protein, 245 aa, Saccharum officinarum
MFGYQKGLDVEAGTSGGGARQLYPGMQESPELRWALIRKIYVILSLQLLLTAVVAAVVVKVRAIPHFFTTTNAGLGLYIFLIILPFIVLCPLYFYHEKHPVNLILLGLFTVAISFSVGLTCAFTSGKVILESAILTTVVVLSLTAYTFWAVNRGKDFSFLGPFLFASLIVLLVFALIQILFPLGKLSQMIYGGLASLIFSGYIVYDTNNIIRRFTYDQYIWAAVSLYLDVINLFLSLMTLFRAAD

SEQ ID NO: 6902 - protein, 249 aa, Zea mays
MFGYQKGLDVEAGTSGAAATGGARQLYPGMQESPELRWALIRKIYVILSLQLLLTAVVAAVVVKVRAIPHFFTTTSAGLGLYIFLIILPFIVLCPLYFYHEKHPVNLILLGLFTVAISFAVGMTCAFTSGKVILESAILTTVVVLSLTAYTFWAVNRGKDFSFLGPFLFAAIIVLLVFALIQILFPLGKLSQMIYGGLASLIFSGYIVYDTNNIIKRYTYDQYVWAAVSLYLDVINLFLSLMTLFRAAD

SEQ ID NO: 6903 - protein, 249 aa, Pennisetum glaucum
MSSAFGYQKGGDLEAGSSAAAGPRELYPGMQESPEMRWALIRKIYVILSLQLLLTAAVAAVVVKVRAIPHFFTTTSAGLGLYIFLIILPFIVLCPLYFYHERHPVNLILLGLFTVAISFAVGMTCAFTSGKVILLSAILTTVVVLSLTAYTFWAVRRGKDFSFLGPFLFASLIVLLVFALIQILFPLGKLSQMIYGGLAALIFSGYIVYDTNNIIRRYTYDQYVWAAVSLYLDVINLFLSLMTLFRAAD

SEQ ID NO: 6904 - protein, 244 aa, Oryza sativa
MFRYEKGGDVEAGTSGGARELYPGMTEPPEMRWALIRKIYVILSMQLLLTAAVAAVVVKVRAISHFFVSSHAGLGLYIFLIILPFIVLCPLYYYHQKHPVNLILLGLFTVAISFAVGMTCAFTSGKVILESAILTTVVVFSLTAYTFWAAKRGRDFSFLGPFLFASLIVLLVFAFIQILFPLGRISQMIYGGIASLIFSGYIVYDTDNIIKRYTYDQYVWAAVSLYLDVINLFLSLMTLFRAAD

SEQ ID NO: 6905 - protein, 230 aa, Cenchrus ciliaris
MSSAFGYQKGGDLEAGSSGAAGPGALYPGMQESPEMRWALIRKIYVILSLQLLLTAAVAAVVVKVRAIPHFFTTTNAGLGLYIFLIILPFIVLCPLYYYHERHPVNLILLGLFTIAISFAVGMTCAFTSGKVILESAILTTVVVFSLTAYTFWAVRRGKDFSFLGPFLFASLIVLIVFALIQILFPLGKLSQMIYGGLASLIFSGYIVYDTNNIIRRYTYDQYVWAAVSL

SEQ ID NO: 6906 - protein, 250 aa, Zea mays
MYFRPPPKGPEWYAGDAETGQAARPLYPMMLEDPRLRWAFIRKVYSILSIQMLLTVAVAAVVVYVRPVALFFVSTAAGFGLYIFLIILPFIVLCPLYYYYQRHPVNLLLLGLFTVAISFAVGLTCAFTKGEVILESAVLTAVVVLSLTAYTFWAAKRGHDFNFLGPFLFAAVMILMLFALIQLFFPLGRISLMIYGGLAALVFCGYIIYDTDNLIKRYSYDEYVWAAVALYLDVINLFLSLVTLFRAADS

SEQ ID NO: 6907 - protein, 250 aa, Zea mays
MYFRPPPKGPEWYASDAETGQAARPLYPMMLEDPRLRWAFIRKVYSILSIQMLLTVAVAAVVVYVRPVALFFVSTPGGFGLYIFLLILPFIVLCPLYYYYQHHPVNLLLLGLFTVAISFAVGLTCAFTKGEVILESAVLTAAVVLSLTAYTFWAAKRGHDFSFLGPFLFAAVMILMLFALIQLFFPLGRISLMIYGGLAALVFCGYIIYDTDNLIKRYSYDEYVWAAVALYLDVINLFLSLLTLFRAADS

SEQ ID NO: 6908 - protein, 250 aa, Zea mays
MYFRPPPKGPEWYASDAETGQAARPLYPMMLEDPRLRWAFIRKVYSILSIQMLLTVAVAAVVVFVRPVALFFVSTPGGFGLYIFLLILPFIVLCPLYYYYQHHPVNLLLLGLFTVAISFAVGLTCAFTKGEVILESAVLTAAVVLSLTAYTFWAAKRGHDFSFLGPFLFAAVMILMLFALIQLFFPLGRISLMIYGGLAALVFCGYIIYDTDNLIKRYSYDEYVWAAVALYLDVINLFLSLLTLFRAADS

SEQ ID NO: 6909 - protein, 250 aa, Panicum virgatum
MYFRPPPKGPEWYSGDAETGQAARPLYPMMLEDPRLRWAFIRKVYSILSIQMLLTVAVAAIVVYVRPVAHFFVSTPGGFGLYIFLIILPFIVLCPLYYYYQHHPVNLLLLGVFTVAISFAVGLTCAFTKGEVILESAILTSVVVVSLTAYTFWAARRGHDFNFLGPFLFAAIMILMVFALIQLFFPLGRVSLMVYGGLAALVFCGYIIYDTDNLIKRYSYDEYVWAAVALYLDVINLFLSLLTLFRAADS

SEQ ID NO: 6910 - protein, 249 aa, Hordeum vulgare
MYFRPPPKGPEWGGDAEAGQAARPLYPMMLESPQLRWAFVRKVYTILSIQMLLTIAVASVVVFVRPVALFFVSSPAGFGLYIFLIILPFIVLCAMYYYYQRHPVNLLLLALFTVAISFAVGLTCAFTKGEVILESAILTAVVVVSLTAYTFWAASRGHDFNFLGPFLFAAVMILMVFALIQAFFPLGRISLMVYGGLAALVFCGYIIYDTDNLIKRYSYDEYVWAAVALYLDVINLFLSLLTLFRASDS

SEQ ID NO: 6911 - protein, 249 aa, Brachypodium distachyon
MYLRPPPKGPEWGGDPEAGSAARPLYPMMLESPQLRWAFVRKVYTILSIQMLLTIAVASVVVFVRPVALFFVSTPAGFGLYIFLIILPFIVLCPLYYYYQRHPVNLLLLGLFTVAISFAVGLTCAFTKGEVILESAILTAVVVVSLTAYTFWAARRGHDFSFLGPFLFAAVMILMVFALIQIFFPLGRVSLMVYGGLAALVFCGYIIYDTDNLIKRYSYDEYVWAAVALYLDVINLFLSLLTLFRAADS

SEQ ID NO: 6912 - protein, 249 aa, Triticum aestivum
  misc_feature (155)..(155): Xaa can be any naturally occurring amino acid
  misc_feature (168)..(168): Xaa can be any naturally occurring amino acid
  misc_feature (171)..(172): Xaa can be any naturally occurring amino acid
MYFRPPPKGPEWGGDAEAGQAARPLYPMMLESPQLRWAFVRKVYTILSIQMLLTIAVASVVVFVRPVALFFVSSPAGFGLYIFLIILPFIVLCPLYYYYQRHPVNLLLLALFTVAISFAVGLTCAFTKGEVILESAILTAVVVVSLTAYTFWAAXRGHDFSFLGPFLXAAXXILMVFALIQAFFPLGRISLMVYGGLAALVFCGYIIYDTDNLIKRYSYDEYVWAAVALYLDVINLFLSLLTLFRASDS

SEQ ID NO: 6913 - protein, 249 aa, Oryza sativa
MYFRPPPKGPEWAGGDAEAGMARPLYPMMLESPQLRWAFVRKVYAILSIQMLLTIAVASVVVFVRPVALFFVSTPAGFALYIFLIILPFIVLCPLYYYYQRHPVNLLLLALFTAAISFAVGLTCAFTKGEVILESAILTAAVVVSLTAYTFWAARRGHDFSFLGPFLFAAVMILMVFALIQVFFPLGRVSLMIYGGLAALVFCGYIVYDTDNLIKRYSYDEYVWAAVALYLDVINLFLSLLTLFRASDS

SEQ ID NO: 6914 - protein, 272 aa, Zea mays
MESKDGTHDPATTAAPPAGAPQPAMPSAETARWGTRQMGPPAAPGAHPENQEAARWTAARGDQELPPYVIIGEPVAAPPPPQHRGKGDSPMEHILDFFNTWSRKAEELASNIWVNLKAAPSMSDAAMGKLSLGAKALSEGGFEKLYKQTFSSSPDEHLKKTFACYLSTATGPVAGTLYLTNLNVAFCSDRPLSFAAPSGQTAWSYYKVMIPLGKIATVEPVTMKESPPEKYVHVVTVDSHDFWFMGFVSYDKAVHYLVEAVSQRGVATAGGK

SEQ ID NO: 6915 - protein, 280 aa, Panicum virgatum
MEGKDGKHDASAAPPAGAPQPAPGQPQPQPPEAARWGTRQMGPPAAPGAHPENQEAARWTAARGDQELPPYVVVGEPVPQQQRQKGDSPMEHILDFFNSWSRKAEELASNIWFNLKTAPSMSDAAMGKLSLGAKALSEGGFEKLYRQTFSSGPDEQLRKTFACYLSTATGPVAGTLYLTSANVAFCSDRPLSFAAPSGQTAWSYYKVMIPLEKVAAVEPVTMKESPPEKYVHVVTVDSHDFWFMGFVSYDKAVHHLTEAVSHRSSSQQQGVAGAAAAGTK

SEQ ID NO: 6916 - protein, 482 aa, Saccharum officinarum
MASASSNAKQSLYPDVDQSHPDLNTPFFSAPTTSTTTGNSLYPTVDPNELAENLFPETAEEEAAPPPPTTEETIVAVPGAQLHLVDPDRSLDLGAGTLSIARLRQGDHSVAVLARLIPGKPHHRRGLFRLFSSGRSDGGAEQEPVQWPLTRDVAAVKLDPAHYFFSLHVPHTDHPDDKDDAEDAEADAEAALSYGLTVVGKGQEKVLEELDRVLEEYTTFSVKQVEAAAKEKSEVMDARAVAEITPEEAVGDKKEVVEEKSAAFWTTIAPNVDDYSSSVARLIARGSGQLVRGIIWCGDITAEGLRRGEEVVKKSVGPSAKPTQVKPSTLRRMKRARRVTKMSNRVANSILSGVLKVTGFVTSTVLNSKPAQKFFKLMPGEVILASLDGFGKVWDAVEVSGKNVMQTSSVVTTSVVTHRYGEQAGEATHNYLHATGNALGAAWAVFKIRKALDPKGNLKKSSFVSQAAHTVAKESIARQKKK

SEQ ID NO: 6917 - protein, 487 aa, Zea mays
MAFASSNAKQSLYPDVDQSHPDLNTPFFSAPTTSTCAGAGAATGNSLYPTVDPNELAQNLFPETVEEDAAPPPPTTEETIIAVPGAQLHLIDPDRSVDLGAGTLSIVRLRQGDHSVAVLARLIHEKPHHRRGLFRLFSSGRSDAGAEQEPVQWPLARDVAAVKLDPAHYFFSLHVPHTDHPDDKDDADGAEADAEAALSYGLTVVGKGQEEVLAELDRVLEEYTTFSVKQVETAAKEKSEVMDARAVAEITPEEAVGDKKEVVEEKSAAFWTTIAPNVDDYSSSVARLIARGSGQLVRGIIWCGDITAGGLRRGEEVMKKSVGPSTKPTQVKPSTLRRMKRARRVTKMSNRVANSILSGVLKVTGFVTSTVLNSKPAQKFFKLMPGEVILASLDGFGKIWDAVEVSGKNVMQTSSVVTTSVVTHRYGEQAGEATHNYLHATGNVLGAAWAVFKIRKALDPKGNMKKSFVSQAAHAVAKESVARQKKK

SEQ ID NO: 6918 - protein, 484 aa, Brachypodium distachyon
MASASNTNQKSLYPEVAQSHPDHNAAFHSNPPAAGATGASLYPTVDPRELAEDLFPADAAEDAAPAPPTVEETLVAVPGTQLHLVDPDRSLDLGAGTLSIVRLRQGDHAVAVLARLTPDKSQQRRGLFRFLSGGGRSSEAQEPVQWPLARDVAAVKLDAAHYFFSLHVPHTDHPDDAEEAAEAEKDAADGESALSYGLTVAGKGQEKVLEELDTVLKEYTTFSVKQVDAAANEKSEVMDTRAVTEITPEEAVGDKKELMEEQSAAFWTTIAPNVDDYSSSVARLIAKGSGQLVRGIIWCGDITAGGLKCGEAVLKKSVGPSGKPAQVKPSSLRRMKRARRVTKMSNRVANSILSGVLKVSGFVTSTVLNSKPAQKFFKLMPGEVILASLDGFGKVWDAVEVSGKNVMQTSSVVTTSVVTHRYGDQAGEITQDYLHATGNALGVAWAVFKIRKALDPKGNLKKSSMASAAAHAVAKESIGRQKRK

SEQ ID NO: 6919 - protein, 482 aa, Oryza sativa
MAAKQSLYPEVNQSHPDLNTAFLANPNRAATASPGGSLYPSVDPQQLAENLFPDAADDAAPPPPTTEEALVAVPGAQLHLVDPDRSMDLGAGTLSVVRLRQGDHSVAVLARLVPEKRSQRRGGLFGFLSGGGKAGDGAAQEPVQWPLTRDVAAVKLDTAHYFFSLHVPHTDHEDDDAEGAEAEKDADGEAALSYGLTVASKGQEAVLAQLDKVLEEYTTFSVKQVEPAAKEKSEVMDTKAVTEITPEEAVGDKKEVVEEQSAAFWTTIAPNVDDYSSSVARLIARGSGQLVRGIIWCGDITAEGLRCGEAVVKKSVGPSGKPSQVKPSTIRRMKRARRVTKMSNRVANSILSGVLKVSGFVTSTVLNSKPAQKFFKLMLGEVILASLDGFGKVWDAVEVSGKNVMRTSSVVTTSVVTHRYGDQAGQVTQDYLHASGNALGVAWAVFKIRKALDPKGNLKKSSLASAAAHAVAKESISRQRRK

SEQ ID NO: 6920 - protein, 447 aa, Solanum phureja
MASKNPNSSSMYPEVVVDQNAPFPSSTSRQNLYPTIDMNDIVENLFPQNDQTAPEEQHYSPSAPPEILEETLLVIPGSILHLIDKHYSVELATGDLFLHRLRQGNNIVAVLVRVGNEIQWPLTKDLAAVKLDDSHYFFSFQAPKDDELDKESSVSDSANDSLNYGLTIASKGQEKLLKELDGILENYSNFAVQKVEEKAAAALGGPVAKELSPADLKSEKKEVLEERCAAYWTTLAPNVEEYNATAAKLVASGSGHLIKGILWCGDVTTDRLKWGNEVLKNRFKTGSKTEVSPETLKRIKRVKRVTKMTEKVAVGVLSGAVKVSGFFTRSLANTKAGKKFFSLLPGEMVLATLDGFSRICDAVEVAGKNVMSTSGTVTTEFVSHRYGEEAANATSEGLDAAGHAFGTAWAVFKIRKALNPKSALKPTALAKSAAKAAAADKKAKSSK

SEQ ID NO: 6921 - protein, 451 aa, Capsicum annuum
MASRNPNSSMYPQVVIARNTPILSSSSTTTPRQNLYPTIDMNDRLENLFPDNDQTAPDQQRYSPSAPPQTLEETLLIIPGSILHLIDKHYSAELANGDLSIHRLGQGNNIFAVVVRAGDEIQWPLTKDIAAVKLDDSHYFFSFQAPKDDESDKDESGNDSLNYGLTIASKGQEKLLKELDGILENYSNFAVQKVEEKAMVALGGPMAKELSPTDLKSEKKKQVMEERCAAYWTTLAPNVEEYNATAAKLVASGSGHLIKGILWCGDVTADRLKWGNEVLKNRFKTGSKTEVSPETLKRIKRVKRVTKMTEKVAVGVLSGAVKVSGLFTRSIANSKAGKKFFSLLPGEMVLATLDGFSRICDAVEVAGKNVMSTSGTVTTEFVSHRYGEEAGAATSEGLDAAGHAFGTAWAVFKIRKALNPKSALKPTALAKSAAKSAAMAAATDKKAKSSK

SEQ ID NO: 6922 - protein, 430 aa, Solanum phureja
MASKNPNSSSMYPQLLIDQNTPFPSSTSRQNLYPIIDMNDLVENLFPQNDQTAPEEQHYSPSAPPEILEETLLVIPGSILHLIDKHYSIELATGDLFLHRLRQGNNIVALLVSVGNEIQWLLTKDLTAVKLDDSHYFFSFQAPKDDESDTESVGDSLNYGLTIASKGQEKLLKELDGILENYSNFAVQKVEEKAAVGLGGPVAKELSLADLKSEKKKEVLEERCAAYWTTLAPNVEEYNAKAAKLVASGSGHLIKGILWCGDVTADGLKRGNEVLKNRFKTGSKTKVSPETLKRIKRVKRVTKVTEKMAVGVLSGAVKVSGFFTRSLANSKAGKKFFSLLPGEMVLATLDGFSRICDAVEVAGKNVMSTSGTVTTEFVSHRYGEEAAKATSEGIHAVGHAFGTVWAINDKKKVSEPQKCLEAHCPGQICC

SEQ ID NO: 6923 - protein, 443 aa, Solanum tuberosum
MASQNPTPPKLYPEVIDSNPESTSPFLTNTQKNKSSSSMYPTIDMKELAENLFPETENNQPNQNSNFVSLEEVIVQIPGAIVHLIDKERSIELASGEFEIVQLKQGDNVVAVLARVGDQIQWPLARDEAAVKLDESHYFFTLRVPSEANDEDGYAENLLNYGLTIASKGQERVLKELDLVLEKYSAFRVEKVKKDKGVAEKWWMAPKDVSPEEMEKKKEDMERSSAAYWTTLAPNVEDYSSSIARMIAAGSGQLIKGILWCGDVTVDRLKWGNDVLMKRMGKGSNSEISPEAMRRMRRVKKMTKMSEKVATGILSGVVKVSGFFTSSIVNSKAGQRFFSLLPGEIVLASLDGFNKVCDAVEVAGKNVMSTTSVVTTGLVQQRHGDQAAQMTREGFDAAGHALGTAWAVFKIRKALNPKGAIKPTTVVKAAAQANLAKLKSKQK

SEQ ID NO: 6924 - protein, 443 aa, Solanum phureja
MASQNPTPPKLYPEVIDSNPESTSPFLTNTQKNKSSSSMYPTIDMKELAENLFPETENNQPNQNSNFVSLEEVIVQIPGAIVHLIDKERSIELASGEFEIVQLKQGDNVVAVLARVGDQIQWPLARDEAAVKLDESHYFFTLRVPSDANDEDGYAENLLNYGLTIASKGQERVLKELDLVLEKYSAFRVEKVKKDKGVAEKWWMAPKDVSPEEMEKKKEDMERSSAAYWTTLAPNVEDYSSSIARMIAAGSGQLIKGILWCGDVTVDRLKWGNDVLMKRMGKGSNSEISPEAMRRMRRVKKMTKMSEKVATGILSGVVKVSGFFTSSIVNSKAGQRFFSLLPGEIVLASLDGFNKVCDAVEVAGKNVMSTTSVVTTGLVQQRHGDQAAQMTREGFDAAGHALGTAWAVFKIRKALNPKGAIKPTTVAKAAAQASLAKLKSKQK

SEQ ID NO: 6925 - protein, 170 aa, Solanum tuberosum
MAGQPEKKPESVYDFTLKDAKGNDVDLSTYKGKVLLIVNVASKCGLTDSNYKDLNHLHEKYKDQGLEILAFPCNQFGAQEPGSNDEIVEFACTRFKSEFPIFDKIEVNGENTSPFYKFLKSAKWGLVGDNIQWNFAKFLVDKNGQVSDRYYPTTSPLSMERDIKVLLGIE

SEQ ID NO: 6926 - protein, 170 aa, Solanum phureja
MAGQPEKKPESVYDFTLKDAKGNDVDLSIYKGKVLLIVNVASKCGLTDSNYKDLNHLHEKYKDQGLEILAFPCNQFGAQEPGSNDEIVEFACTRFKSEFPIFDKIEVNGENTSPFYKFLKSAKWGLLGDNIQWNFAKFLVDKNGQVSDRYYPTTSPLSMERDIKVLLGIE

SEQ ID NO: 6927 - protein, 170 aa, Solanum tuberosum
MAGQPEKKPESVYDFTLKDAKGNDVDLSTYKGKVLLIVNVASKCGLTDSNYKDLNHLHEKYKDQGLEILAFPCNQFGAQEPGSNDEIVEFACTGFKSEFPIFDKIEVNGENTSPFYKFLKSAKWGLVGDNIQWNFAKFLVDKNGQVSDRYYPTTSPLSMERDIKVLLGIE

SEQ ID NO: 6928 - protein, 169 aa, Capsicum annuum
MASQPEKQKSIYDLTVKDAKGNDVDLSTYKGKVLLIVNVASKCGLTNSNYIDLNHLYEKYKDQGMEILAFPCNQFGAQEPGTNDEIVEFACTNFKSEFPIFDKIEVNGENTSPVYKFLKSAKWGLLGDNIQWNFAKFLVDKNGQVSDRYYPTTSPLSIERDIKVLLGIA

SEQ ID NO: 6929 - protein, 170 aa, Solanum phureja
MAGQPEKKPQSVYDFTLKDAIGNDVDLSIYKGKVLLIVNVASKCGMTNSNYTELNQLYEKYKDQDLEILAFPCNQFGEEEPGTNDQILDFVCTRFKSDFPIFDKIEVNGENASPLYKFLKSGKWGIFGDDIQWNFAKFLVDKNGQVVDRYYPTTSPLTIERDMKKLLEII

SEQ ID NO: 6930 - protein, 170 aa, Solanum melongena
MAGQPEKKPESVYDFTLKDAMGNDVDLSIYKGKVLLIVNVASKCGMTNSNYTELNQLYEKYKDQGLEILAFPCNQFGEEEPGTNNQILDFVCTRFKSDFPIFDKVEVNGENASPLYKFLKSGKWGIFSDDIQWNFAKFLVDKNGQVVDRYYPTTSPLTIERDMKKLLGIV

SEQ ID NO: 6931 - protein, 170 aa, Solanum lycopersicum
MAGQPEKKPQSVYDFSLKDATGNDVDLSIFKGKVLLIVNVASKCGMTNSNYTELNQLYEKYKDQGLEILAFPCNQFGEEEPGTNDQILNFVCTRFKSDFPIFDKIEVNGENASPLYKFLKSGKWGIFGDDIQWNFAKFLVDKNGQVVDRYYPTTSPLTIERDMKKLLETI

SEQ ID NO: 6932 - protein, 170 aa, Solanum tuberosum
MAGQPEKKPQSVYDFTLKDATGNDVDLSIYKGKVLLIVNVASKCGMTNSNYTELNQLYEKYKDQGLEILAFPCNQFGEEEPGTNNQILDFVCTRFKSDFPIFDKIEVNGENASPLYKFLKSGKWGIFGDDIQWNFAKFLVDKNGQVVDRYYPTTSPLTIKRDMKKLFETI

SEQ ID NO: 6933 - protein, 170 aa, Coffea canephora
MASLSEKAPQSVYDFTVKDAKGNDVDLSIYAGKVLLIVNVASKCGFTNSNYTELNELYQKYKDQGLEILGFPCNQFGQQEPGSNDEIVDFVCTRFKSEFPIFDKIEVNGENSAPIYKFLKKGKWGLIGDNIQWNFAKFLVDKNGQAVDRYYPTTSPLTIERDIKKLLGVS

SEQ ID NO: 6934 - protein, 170 aa, Petunia hybrida
MASQSKKNPESVYDFTVKDAMGNDVDLSIYKGKVLLIVNVASKCGMTNSNYTGLNQLYEKYKDQGLQILAFPCNQFGEEEPGSNDQILDFVCTRFKSEFPIFDKIDVNGENTSPLYKFLKSGQWGIIGDDIQWNFAKFLVDKNGHAVDRYYPTTSPLTIERDIKKLLCIV

SEQ ID NO: 6935 - protein, 125 aa, Solanum tuberosum
MTNSNYTELNQLYEKYKDQGLEILAFPCNQFGEEEPGTNNQILDFVCTRFKSDFPIFDKIEVNGENASPLYKFLKSGKWGIFGDDIQWNFAKFLVDKNGQVVDRYYPTTSPLTIKRDMKKLFETI

SEQ ID NO: 6936 - protein, 242 aa, Unknown
  Sequence found in Organisms: Solanum tuberosum, Solanum phureja
MWNQAYRKDDVEFGTAPLYPAMLESPELRWSFIRKVYSIISIQLLLTIAVASVVVTVHPISHFFAATNAGLALYIVLIITPFITLCPLYYYHQKHPVNYLLLGLFTVSLAFTIGLTCAFTSGKVILEAVILTTAVVISLTLYTFWAAKRGQDFNFLGPFLFGALIVLLLFSFIQILFPLGKISVMIYGCLASIIFCGYIVYDTDNLIKRYTYDEYIWAAISLYLDVINLFLALLSIFRAADS

SEQ ID NO: 6937 - protein, 242 aa, Solanum tuberosum
MWNQAYRKDDVESGTAPLYPAMLESPELRWSFIRKVYSIISIQLLLTIAVASVVVTVHPISHFFAATNAGLALYIVLIITPFITLCPLYYYHQKHPVNYLLLGLFTVSLAFTIGLTCAFTSGKVILEAVILTTAVVISLTLYTFWAAKRGQDFNFLGPFLFGALIVLLLFSFIQILFPLGKISVMIYGCLASIIFCGYIVYDTDNLIKRYTYDEYIWAAISLYLDVINLFLALLSIFRAADS

SEQ ID NO: 6938 - protein, 242 aa, Solanum melongena
MWNQAYRKDDVETGTAPLYPAMLESTELRWSFIRKVYSIISIQLLLTIAVASVVVTVHPVSHFFATTNAGLALYIVLIITPFITLCPLYYYHQKHPVNYLLLGLFTVSLAFTIGLTCAFTSGKVILEAVILTTAVVISLTLYTFWAAKRGQDFNFLGPFLFGALIVLLLFSFIQILFPLGKISVMIYGCLASIIFCGYIVYDTDNLIKRYTYDEYIWAAISLYLDVINLFLSLLTIFRAADS

SEQ ID NO: 6939 - protein, 242 aa, Nicotiana tabacum
MWNQAYRKDDVEAGTRPLYPAMLEAPELRWSFIRKVYSIITIQLLLTIAVASVVVTVHPISHFFATTSAGLGLYIVLIITPFITLCPLYYYHQKHPVNYLLLGIFTVSLAFTIGLTCAFTSGKVILEAVILTTAVVISLTLYTFWAARRGQDFNFLGPFLFGALIVLLVFAFIQILFPLGKISVMIYGCLASIIFCGYIVYDTDNLIKRYTYDEYIWAAISLYLDIINLFLSLLTVFRAADN

SEQ ID NO: 6940 - protein, 242 aa, Capsicum annuum
MWNQPYRKYDVEAGTAPLYPEMLESPELRWSFIRKVYSIITIQLLLTIAVASVVVTVHPISHFFATTSAGLGVYIVLVITPFITLCPLYYYHQKHPVNYLLLGLFTVSLAFTVGLTCAFTSGKVILEAVILTTAVVISLTAYTFWAAKRGQDFNFLGPFLFGALVVLLLFSLIQIFFPLGKISVMIYGGLASIIFCGYIVYDTDNLIKRYTYDEYIWAAISLYLDVINLFLSLLTIFRAADN

SEQ ID NO: 6941 - protein, 242 aa, Petunia hybrida
MWNHAYRKDDVEAGTRPLYPAMLESPELRWSFIRKVYSIITIQLLLTIAVASVVVTVHPISHFFATTNAGLALYIVLIITPFITLCPLYYYHQKHPVNYLLLGVFTVSLAFTVGLTCAFTSGKVILEAAILTAAVVISLTVYTFWASRRGQDFNFLGPFLFGALIVLLVFAFIQILFPLGKISVMIYGGLASLIFCGYIVYDTDNLIKRYTYDEYIWAAISLYLDVINLFLSLMTIFRAADS

SEQ ID NO: 6942 - protein, 242 aa, Orobanche aegyptiaca
MWGRPYRKDDVESSREPLYPMMLESPELRWSFIRKIYTIVSIQLLLTIAVGALVVTVHPISHFFAATTAGLVVYIILIITPFIVLCPLYSYYQKHPLNYILLGVFTVSLAFAVGLTCSYTSGKVILEAVILTAAVVVSLTLYTFWAAKRGHDFNFLGPFLFGALIVLMLFSLIQIFFPLGKISMMIYGCLASIIFCGYIIYDTDNLIKRYTYDEYIWAAVALYLDIINLFLALLNIFRAADT

SEQ ID NO: 6943 - protein, 242 aa, Tropaeolum majus
MWGQSYGKTDVETGSRPLYPMMLESPELRWSFIRKIYSIIAIQLLVTVAVAATVVTVHPISHFFVSTGAGLALYIVLIITPFIVLCPLYYYHQKHPVNYLLLGIFTIALSFSVGLTCAFTSGKVILESVILTGVVVVSLTLYTFWAAKRGYDFNFLGPFLFGAIIVLMVFGMIQIFFPLGKISVMIYGCLASIIFCGYIVFDTDNLIKRYSYDEYIWAAVSLYLDIINLFLSLLTIFRAADS

SEQ ID NO: 6944 - protein, 241 aa, Ipomoea nil
MWNYAYKGDEESGSAPLYPTMLENPELRWSFIRKVYSIVAIQLVLSIAVGAVVITNHHISRFFATTGAGLALYIVLIITPFIVLCPLYYYHQKHPYNYILLGIFTVALSFATGLTCAYTSGKVILEAAILTAAVVIALTLYTFWAAKRGQDFNFLGPFLFGAILVLMLFSLIQIFFPMGKISVMIYGCLASIVFCGYIVYDTDNLIKRYSYDEYIWAAVALYLDVINLFLSLLTVFRAADS

SEQ ID NO: 6945 - protein, 239 aa, Brassica napus
MWNQKYDLESAQTPLYPMMMESPELRWSFIRKVYSIISIQLLVTIAVAATVVKVHPISVFFTTTSAGFALYILVIFTPLIVMCPLYYYHQKHPVNYLLLAIFTVSLAFAVGLTCAFTSGKVILEAVILTAVVVVSLTLYTFWAAKRGHDFNFLGPFLFGAVIVLMVFSFIQILFPLGKISVMIYGCLASIIFCGYIVYDTDNLIKRHSYDEYIWAAISLYLDVINLFLSLLTLLRAADS

SEQ ID NO: 6946 - protein, 239 aa, Brassica napus
MWNQKYDLESAQTPLYPMMMESPELRWSFIRKVYSIISIQLLVTIAVAATVVKVHPISVFFTTTSAGFALYILLIVTPLIVMWPLYYYHQKHPVNYLLLAIFTVSLAFAVGLTCAFTSGKVILEAVILTAVVVVSLTLYTFWAAKRGHDFNFLGPFLFGAVIVLMVFSFIQILFPLGKISVMIYGCLASIIFCGYIVYDTDNLIKRHSYDEYIWAAISLYLDVINLFLSLLTLLRAADS

SEQ ID NO: 6947 - protein, 239 aa, Raphanus sativus
MWNQKYDLESAQTPLYPMMMESPELRWSFIRKVYSIISIQLLATIAVAATVVKVEPISVFFTTTNAGLALYILLIITPLIVMCPLYYYHQKHPVNYLLLAIFTVSIAFAVGLTCAFTSGKVILEAVILTAVVVVSLTLYTFWAVKRGHDFNFLGPFLFGALIVLVVFSFIQIFFPLGKISVMIYGCVASIIFCGYIVYDTDNLIKRHSYDEYIWAAVSLYLDVINLFLSLLSLLRAADS

SEQ ID NO: 6948 - protein, 243 aa, Mimulus guttatus
MWNQPYGGKYDVESGGRPLYPMMLESPELRWSFIRKIYTIVAIQLLCTIAVGAVVVTIHPISLFFTTTGAGLALYIILIITPFIVLCPLYYYYQRHPWNYLLLGIFTLSLAFSVGLTCAFTSGKVILESVILTAAVVISLTLYTFWAAKRGHDFNFLGPFLFGALMVLMLFAIIQIFFPLGRISVMIYGCLASIIFCGYIVYDTDNLIKRYTYDQYIWAAVALYLDVINLFLSLMTVFRAADS

SEQ ID NO: 6949 - protein, 239 aa, Arabidopsis lyrata
MWNQKHDLESAQTPLYPMMLESPELRWSFIRKVYSIISIQLLVTIAVAATVVKVHSISVFFTTTTAGFALYILVIFTPLIVMCPLYYYHQKHPVNYLLLGIFTVALAFAVGLTCAFTSGKVILESVILTSVVVISLTLYTFWAAKRGHDFNFLGPFLFGAVIVLMVFSFIQILFPLGKISVMIYGCLASIIFCGYIVYDTDNLIKRHSYDEYIWAAVSLYLDVINLFLSLLTLLRAADS

SEQ ID NO: 6950 - protein, 242 aa, Coffea canephora
MWTQQYRKDDLESGARPLYPMMLESPELRWAFIRKIYSIITAQLVLTVAVAAVVVTYHPIARFFTTTGAGLALYIVLIITPFIVLCPLYYYHQKHPVNYLLLGVFTLTLAFAVGLTCAYTEGKVILESVILTGAVVISLTLYTFWAAKRGHDFNFLGPFLFGAVVVLMLFAIIQILFPLGRISTMIYGCLASIIFCGYIIYDTDNLIKRYTYDEYIWAAVALYLDIINLFLSILTIFRAADS

SEQ ID NO: 6951 - protein, 245 aa, Solanum phureja
MWQQTWNTPYRKDDVEAGERPLYPAMLENPQLRWGFIRKVYSILSFQLLITIGVAAVVVTVHPIAHFFVSTGAGLALYILLIISPFITLWPLYYYHQKHPVNFLLLGLFTVTLAFAVGLTCAFTSGKVILESVILTTAVVLSLTVYTFWAARRGHDFNFLGPFLFGALMVLMLFAFIQLLFPLGRLSLMIYGCLASILFCAYIIYDTDNLIKRYTYDEYIWAAVALYLDVINLFLSILTIFRAAE

SEQ ID NO: 6952 - protein, 242 aa, Manihot esculenta
MWAQPYRKSDVEAGTRPLYPMMLESPQLRWAFIRKVYSILSFQLLATIAVASVVVSVHPIANFFVSTGTGLALYIVLIITPFVALCPLYYYHQKHPVNYLLLGIFTISLSFAVGLTCAFTSGKVILESVILTTVVVLSLTLYTFWAARRGHDFNFLGPFLFGAVLVLMVFALIQILFPLGRISVMIYGCLASIIFCGYIIYDTDNLIKRYSYDEYIWASVSLYLDVINLFLSLLTLFRAAES

SEQ ID NO: 6953 - protein, 239 aa, Arabidopsis thaliana
MWNQKHDLESAQTPLYPMMSESPELRWSFIRKVYSIISIQLLVTIAVAATVVKVHSISVFFTTTTAGFALYILLILTPLIVMCPLYYYHQKHPVNYLLLGIFTVALAFAVGLTCAFTSGKVILESVILTAVVVISLTLYTFWAAKRGHDFNFLGPFLFGAVIVLMVFSFIQILFPLGKISVMIYGCLASIIFCGYIVYDTDNLIKRHSYDEYIWAAVSLYLDVINLFLSLLTLLRAVDS

SEQ ID NO: 6954 - protein, 242 aa, Ricinus communis
MWAHPYRKSDVEAGARPLYPMMLESPELRWSFIRKVYSILCIQLLATIAVASVVVSVRPIATFFVTTGAGLALYIVLIIMPFIVICPLYYYHQKHPVNYLLLGVFTISLAFAVGLTCAFTSGKVILESVILTTVVVLSLTFYTFWAARRGHDFNFLGPFLFGAIMVLMVFALIQILFPLGRISVMIYGCLASIIFCGYIIYDTDNLIKRFSYDEYIWAAVSLYLDVINLFLSLLTVFRAAES

SEQ ID NO: 6955 - protein, 245 aa, Solanum lycopersicum
MWQQTWNTPYRKDDVEGGARPLYPAMLENPQLRWGFIRKVYSILSLQLLITIAVGAVVVTVHPIAHFFVSTGAGLALYILLIIAPFITLSPLYYYHQKHPVNFLLLGLFTVTLAFAVGLTCAFTSGKVILESVILTAAVVLSLTIYTFWAARRGHDFNFLGPFLFGALMVLMLFAFIQLLFPLGRLSVMIYGCLASILFCAYIIYDTDSLIKRYTYDEYIWAAVGLYLDVINLFLSILTIFRAAE

SEQ ID NO: 6956 - protein, 244 aa, Arachis hypogaea
MWNQPFGKTDLERGGGARPLYPMMLESPELRWSFIRKVYIIIAFQLLATIAVGAVVVSVHPIALFFAGTGAGLALYIVLIFVPFITLCPLYYYYQKHPVNYLLLGIFTVSLAFVVGLTCAFTSGKVILESVILTTVVVVALTLYTFWAARRGHDFNFLGPFLFGAVLVLMVFAFIQILFPLGKLSVMIYGCLASIIFCGYIIYDTDNLIKRYSYDEYIWASVSLYLDVINLFLSLLSIFRAAES

SEQ ID NO: 6957 - protein, 242 aa, Gossypium hirsutum
MWNQPYRKNDTEAGPRPLYPMMLEPPEMRWAFIRKIYSIIAVQLFATIAVAATVVTVHPISNFFVSTGAGLALYIVLIITPFITLCPLYYYYQKHPVNYLLLGVFTVSLAFAVGLTCAFTSGKVILESVILTTVVVVALTLYTFWAAKRGHDFNFLGPFLFGAVLVLMVFALIQILFPLGRISVMIYGCLASIIFCGYIIYDTDNLIKRHSYDEYIWAAVSLYLDIINLFLALLTVFRAADS

SEQ ID NO: 6958 - protein, 242 aa, Citrus sinensis
MWAQPYRKSDVEAGATPLYPMMSESPQLRWAFIRKIYSIIAIQLLATIAVASVVVSVRPISHFFSSTGAGLALYIVLIITPFIVLCPLYYYYQKHPVNYLLLGVFTIALSFAVGLTCAYTKGEVILESAILTAVVVISLTLYTFWAARRGHDFNFLGPFLFGAVMVLLVFAFIQILFPLGRISVMIYGGLASIIFCGYIIYDTDNLIKRYSYDEYIWAAVALYLDIINLFLSLLTIFRAADN

SEQ ID NO: 6959 - protein, 242 aa, Carica papaya
MWAVPPRKNDLESGARPLYPMMLESPELRWAFIRKIYSIISIQLLATIAVAATIVSVRPIALFFVTTGAGLALYIILIIMPFIVLCPLYYYHQKHPVNYLLLGVFTISLAFSVGLTCAFTSGKVILESVILTAVVVISLTLYTFWAARRGHDFNFLGPFLFGAVLVLLVFALIQMLFPLGKISVMIYGCLASIIFCGFIVYDTDNLIKRYTYDEYIWAAVALYLDIINLFLSLLTIFRAAES

SEQ ID NO: 6960 - protein, 174 aa, Triticum aestivum
MAAAGDAGEKKMITLKSSDGEEFEVEEAVAMESQTIRHMIEDDCADNGIPLPNVNSKILSKVIEYCNKHVQAKPADGAAAAAGASDAAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 6961 - protein, 175 aa, Triticum aestivum
MAAAGDAGEKKMITLKSSDGEEFEVEEAVAMESQTIRHMIEDDCADNGIPLPNVNSKILSKVIEYCNKHVQAKPADGAAAAGAGASDAAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 6962 - protein, 176 aa, Triticum aestivum
MAAAGDAGEKKMITLKSSDGEEFEVEEAVAMESQTIRHMIEDDCADNGIPLPNVNSKILSKVIEYCNKHVQAKPADGAAAGAGASDASAAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 6963 - protein, 175 aa, Triticum aestivum
MAAAGDAGEKKMITLKSSDGEEFEVEEAVAMESQTIRHMIEDDCADNGIPLPNVNSKILSKVIEYCNKHVQAKPADGAAAGAGAGASDAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 6964 - protein, 114 aa, Secale cereale
  misc_feature (85)..(86): Xaa can be any naturally occurring amino acid
  misc_feature (101)..(101): Xaa can be any naturally occurring amino acid
MAAAGDAGEKKMITLKSSDGEEFEVEEAVAMESQTIRHMIEDDCADNGIPLPNVNSKILSKVIEYCNKHVQAKPADGAAAAAGAXXPPPRPPPPRTSRTGXQSSSRSTRPPSST

SEQ ID NO: 6965 - protein, 172 aa, Triticum aestivum
MAAAGDAGEKKMVTLKSSDGEEFEVEEAVAMESQTIRHMIEDDCADNGIPLRRGGSMILSKVIEYCNKHVQAKPADAAAAGAAAPDAAAPPAEDLKNWDAEFVKVDQATLFDLILAANFLNIKGLLDLTCQTVADMIKGKTPEEIRKTFNIKNDFPPEEEEEIRTENQWAFE

SEQ ID NO: 6966 - protein, 175 aa, Hordeum vulgare
MAAAGDAGEKKMITLKSSDGEEFEVEEAVAMESQTIRHMIEDDCADNGIPLPNVNSKILSKVIEYCNKHVQAKPADAGASSDTASAAAAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 6967 - protein, 177 aa, Hordeum vulgare
MAAAGDAGEKKMITLKSSDGEEFEVEEAVAMESQTIRHMIEDDCADNGIPLPNVNSKILSKVIEYCNKHVQAKPADAGAASDTASAAAAAAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 6968 - protein, 171 aa, Avena sativa
MAAADDSKKMITLKSSDGEEFEVEEAVAMESQTIRHMIEDDCADNGIPLPNVNSKILSKVIEYCNKHVQAAKPAADCAAAAASDSTPPAPAEDLKNWDAEFVKVDQATLFDLILAANYLNIKGLLDLTCQTVADMIKGKTPEEIRKTFNIKNDFTAEEEEEIRRENQWAFE

SEQ ID NO: 6969 - protein, 167 aa, Secale cereale
GEKKMITLKSSDGEEFEVEEAVAMESQTIRHMIEDDCADNGIPLPNVTSKILSKVIEYCNKHVQAKPADAAAGAAAGAAASDAAPPAEDLKNWDAEFVKVDQATLFDLILAANFLNIKGLLDLTCQTVADMIKGKTPEEIRKTFNIKNDFTPEEEEEIRRENQWAFE

SEQ ID NO: 6970 - protein, 169 aa, Pennisetum glaucum
MASAEAEKKMITLRSSDGEEFEVEEAVAMESQTIRHMIEDDCADNGIPLPNVNAKILSKVIEYCNKHVHAAKPADDAAPAAASDSGAGAEDLKNWDSEFVKVDQATLFDLILAANYLNIKGLLDLTCQTVADMIKGKTPEEIRKTFNIKNDFTPEEEEEIRRENQWAFE

SEQ ID NO: 6971 - protein, 168 aa, Brachypodium distachyon
MASDGEKKMITLKSSDGEEFEVEETVAMESQTIRHMIEDDCADNGIPLPNVNSKILSKVIEYCNKHVHAADATDAAAANTSAAPAAPTDDLKNWDADFVKVDQATLFDLILAANYLNIKGLLDLTCQTVADMIKGKTPEEIRKTFNIKNDFTPEEEEEIRRENQWAFE

SEQ ID NO: 6972 - protein, 168 aa, Lolium multiflorum
MAAEDKKMITLKSSDNEEFEVDEAVAMESQTIRHMIEDDCADNGIPLPNVNAKILSKVIEYCSKHVQAAKPADGAAAAADGAPAPAPAEDLKNWDAEFVKVDQATLFDLILAANYLNIKGLLDLTCQTVADMIKGKTPEEIRKTFNIKNDFTAEEEEEIRRENQWAFE

SEQ ID NO: 6973 - protein, 160 aa, Triticum aestivum
MAAAGDAGEKKMVTLKSSDGEEFEVEEAVAMESQTIRHMIEDDCADNGIPLPNVTSKILSKVIEYCNKHVQAKPADAAAAGAAAPDAAAPPAEDLKNWDAEFVKVDQATLFDLILAANFLNIKGLLDLTCQTVADMIKGKTPEEIRRTFNIKSDFTPQEE

SEQ ID NO: 6974 - protein, 169 aa, Saccharum officinarum
MASEGDNKKMITLRSSDNEEFEVEEAVAMESQTIRHMIEDDCADNGIPLPNVNSKILSKVIEYCNKHVHAAAKPADAADANAAAAAGGGEDLKNWDAEFVKVDQATLFDLILAANYLNIKGLLDLTCQTVADMIKGKTPEEIRKTFNIKNDFTQEEEDEIRRENQWAFE

SEQ ID NO: 6975 - protein, 169 aa, Saccharum officinarum
MASEGDNKKMITLRSSDNEEFEVEEAVAMESQTIRHMIEDDCADNGIPLPNVNSKILSKVIEYCNKHVHAAARPADAADANAAAAAGGGEDLKNWDAEFVKVDQATLFDLILAANYLNIKGLLDLTCQTVADMIKGKTPEEIRKTFNIKNDFTQEEEDEIRRENQWAFE

SEQ ID NO: 6976 - protein, 169 aa, Sorghum bicolor
MASEGDNKKMITLRSSDNEEFEVEEAVAMESQTIRHMIEDDCADNGIPLPNVNSKILSKVIEYCNKHVHAAAKPAEGADANAAAAAGGGEDLKNWDAEFVKVDQATLFDLILAANYLNIKGLLDLTCQTVADMIKGKTPEEIRKTFNIKNDFTQEEEDEIRRENQWAFE

SEQ ID NO: 6977 - protein, 96 aa, Saccharum officinarum
MAAEGEKKMITLKSSDGEEFEVEEAVAMESQTIRHMIEDDCADNGIPLPNVNSKILSKVIEYCNKARTCRRSRCRSLQGRLRRRGCRRRQQHRRLR

SEQ ID NO: 6978 - protein, 167 aa, Cynodon dactylon
MITLKSSDGEEFEVEEAVAMESQTIRHMIEDDCADNGIPLPNVNSKILSKVIEYCNKHVHAAAAAKAGSDDAGANNSSASVTAASGGEDLKNWDADFVKVDQATLFDLILAANYLNIKGLLDLTCQTVADMIKGKTPEEIRKTFNIKNDFTPEEEEEIRRENQWAFE

SEQ ID NO: 6979 - protein, 240 aa, Triticum aestivum
  misc_feature (4)..(4): Xaa can be any naturally occurring amino acid
  misc_feature (71)..(71): Xaa can be any naturally occurring amino acid
  misc_feature (75)..(76): Xaa can be any naturally occurring amino acid
  misc_feature (156)..(156): Xaa can be any naturally occurring amino acid
  misc_feature (167)..(167): Xaa can be any naturally occurring amino acid
PTMXFHCRLQGKRPLFQPDDMSAAAAAVAVPDEAEAEAKPSSSSEEVKEPEPGTEKQEEKPALVLVAEDGXEVRXXEPAARMSQMLRHMMEDGCADGRIPTANIHSDILEMVVEYCEKHGPYYDPEASERDRYPFPPFPIELTPTVSSIKPVTYVXPDPHGLKDWDXDFISLDNSTLFEIILAANYLNIEDLLDLGTSTVADKMRGKKPEEIREIFEIENDYTPEQEAEVRKENAWAFED

SEQ ID NO: 6980 - protein, 165 aa, Arabidopsis lyrata
MEELVGLLRIRVKRGINLAQRDTLSSDPFVVITMGSQKLKTRTVENNCNPEWNEELTLALKHPDEPVNLIVYDKDTFTSHDKMGDAKIDIKPFLEVHKMGLQELPDGTEIKRVVPTRVNCLSEASSIVSINGKIVQDMILLLKNVECGEVEIQLEWIEIPGSRGL

SEQ ID NO: 6981 - protein, 165 aa, Unknown
  Sequence found in Organisms: Brassica napus, Brassica juncea, Brassica oleracea
MEELAGLLRIRVKKGINLARRDSLSSDPFVVITMGTQKLKGRTVENNCNPEWNEELTLALKHPNEPVTLIVYDKDTFTSHDKMGDAKIDIKPFLEVHKLGLQELPDGTVIKRVLPTKENCLSEESRIVYHNGKIVQDMILVLRNVECGEVEIQLEWIEIPGGRGL

SEQ ID NO: 6982 - protein, 165 aa, Raphanus sativus
MEELAGLLRIRVKKGINLARRDSLSSDPFVVITMGTQKLKGRTVENNCNPEWNEELTLALKHPNEHVILIVYDKDTFTSHDKMGDAQIDIKPFLEVHKLGLQELPDGTVIKSVLPTKENCLSEESRIVYHNGKIVQDMILVLRNVECGEVEIQLEWIEIPGGRGL

SEQ ID NO: 6983 - protein, 165 aa, Brassica juncea
MEELAGLLRIRVKKGINLARRDSLSSDPFVVVTMGTQKLKGRAVENNCNPEWNEELTLALKHPNEPVILNVYDKDTFTSHDKMGDVQIDIKPFLEVHKLGLQELPDGTVIKRVLPTKENCLSEESRIVYQNGKIVQDMILVLRNVECGEVEIQLEWIEIPGGRGL

SEQ ID NO: 6984 - protein, 165 aa, Raphanus sativus
MEELAGLLRIRVKKGINLARRDSLSSDPFVIITMGTQKLKGRAVENNCNPEWNEELTLAIKHPNEHVILTVYDKDTFTSHDKMGDAQIDIKPFLEVHKLGLQELPDGTVIKSVLPTKENCLSEESRIVYHNGKIVQDMILVLRNVECGEVEIQLEWIEIPGGRGL

SEQ ID NO: 6985 - protein, 156 aa, Brassica rapa
IRVKKGINLARRDSLSSDPFVVITMGTQKLKGRTVENNCNPEWNEELTLALKHPNEPVTLIVYDKDTFTSHDKMGDAKIDIKPFLEVHKLGLQELPDGTVIKRVLPTKENCLSEESRIVYHNGKIVQDMILVLRNVECGEVEIQLEWIEIPGGRGL

SEQ ID NO: 6986 - protein, 180 aa, Thellungiella halophila
MTQTNAGAGTGATSTAETPQPQPQSNEMVLHTGSLSFSSHMSKEDEEMTRSALSAFRAKEDEIEKRRMEVRQRIQAQLGRVEEETKRLSTIREELESMADPMRKEVSVVRKKIDSVNKELKPLGSTVQKKEREYKEALDTFNEKNREKVQLITKLMELVGESEKLRMLKLEELSKSIESV

SEQ ID NO: 6987 - protein, 218 aa, Raphanus sativus
SATIGLLEEPHGNSPEDSSSCFGLRKKNSTKEKPKMTQTNAGASTGAAATTTELPPPPQPQRNEMVLHTGSLSFSSHMSREDEEMTRSALSAFRAKEDEIEKRRMEVRERIQAQLGRVEEETRRLSTLREELESMPDPMRKEVSVVRKKIDSVNKELKPLGSTVQKKEREYKEALDTFNEKNREKVQLITKLMELVGESEKLRMKKLEELSKSIEETV

SEQ ID NO: 6988 - protein, 187 aa, Brassica napus
  misc_feature (130)..(130): Xaa can be any naturally occurring amino acid
MTQTNAGASTGAAAAATTTELPPPQPQPQTQRSEMVLHTGSLSFSSHMSREDEEMTRSALSAFRAKEDEIEKRRAEVRERIQAQLGRVEEETRRLSTLREEIESMADPMRKEVSVVRKKIDSVNKELKPXGSTVQKKEREYKEALDTFNEKNREKVQLITKLMELVGESEKLRMKKLEELSKSIESV

SEQ ID NO: 6989 - protein, 133 aa, Arabidopsis lyrata
MTQTNAGAGTGPPEPPQPQSNEMVLHTGSLSFSSHMSKEDEEMTRSALSAFRAKEEEIDKRRMEVRERIQAQLGRVEEETRRLSTIREELETMADPMRKEVYVVRKKIDSVNKELKPFRFHCSKEGEGIQRST

SEQ ID NO: 6990 - protein, 175 aa, Raphanus sativus
MTQTNAGAGTGPPEPPQPQSNEMVLHTGSLSFSSHMSKEDEEMTRSALSAFRAKEEEIDKRRMEVRERIQAQLGRVEEETRRLSTIREELETMADPMRKEVSMVRKKIDSVNKELKPLGSTVQKKEREYKEALDTFNEKNREKVQLITKLMELVGESEKLRLKKLEELSKSIETV

SEQ ID NO: 6991 - protein, 435 aa, Arabidopsis thaliana
MSVTAGVSESAIAVREKLKGGIGQTKVRRYWPGKAPEWAEEAEEDDDVRMQKFSVLDRAFPKNDDLGVARKDDPRLRRLAQTKVENRDEVRADHRRIRQAEIISTEEEESRNQENRDEDDDEDALEERRRRIKEKNLRRAQEEAALLPLEEEDEIQEEEEEEEESEYETDSEDDMPGIALIKPVFVPKAERDTIAERERLEAEEEALEELAKRKLEQRKIETKQIVVEEVRKDEEIRKNILLEEANIGDVETDDELNEAEEYEVWKTREIGRIKRERDAREAMLREREEIEKLRNMTEQERRDWERKNPKPSSAQPKKKWNFMQKYYHKGAFFQADPDDEAGSAGTDGIFQRDFSAPTGEDRLDKSILPKVMQVKHFGRSGRTKWTHLVNEDTTDWSNPWTSNDPLREKYNKKMAGMDAPIAKPKGSKKMKDWET

SEQ ID NO: 6992 - protein, 435 aa, Arabidopsis lyrata
MSVTAGVSDAAIAVRAKLQGGIGQTRVRRYWPGKAPEWAEEAEEDEDVRMQTASVLDRSFPKQDDLGVARKDDPRLRRLAQTRVENRDEVRADHRRIRQAEIISTEEEDSRNQETRDEDDDEDALEERRRRIREKNLRRAQEEAALLPLEEEDELQEEEEEEEESEYETDSEDEMPGIAMIKPVFVPKAERDTIAERERLEAEEEALEELAKRKLEKRKIETKQIVVEEVKKDEEIRKNILLEEANIGDVETDDELNEAEEYEVWKTREIGRIKRERDAREAMLREREEIEKLRNMTEQERREWERKNPKPSSTQPKKKWNFMQKYYHKGAFFQADPDDEAGSAGTDGIFQRDFSAPTGEDRLDKSILPKVMQVKHFGRSGRTKWTHLVNEDTTDWSNPWTSNDPLREKYNKKMAGMDAPIAKPKGSKKMKDWET

SEQ ID NO: 6993 - protein, 499 aa, Brassica rapa
MAFTPLFSLLSVITLSLLITTDASSRSLLPSHETTVLDVVSSLQQTQHILSLDPTLTSLTTTTSIPGSDPVFLNSSSPLSLELHSRDTLVASQHKDYKSLVLSRLERDSSRVAGITAKIRFAVEGIDRSDLKPVYNDETSYQPEDLTTPVVSGASQGSGEYFSRIGVGTPAKEMFMVLDTGSDINWIQCQPCSDCYQQSDPVFDPASSSTFKSLSCSAPQCGSLEVSACRSDKCLYQVSYGDGSFTVGDYATDTVTFGTNGKVNDVALGCGHDNEGLFTGAAGLLGLGGGALSMTNQIKATSFSYCLVDRDSGKSSSLDFNSVQAGTGDATAPLLRNSKIDTFYYVGLSGFSVGGQQVSIPSSVFAVDASGAGGVILDCGTAVTRLQTQAYNSLRDAFVKLTANLKKGTSSISLFDTCYDFSSLSTVKVPTVAFHFTGGKSIDLPAKNYLIPVDDAGTFCFAFAPTSSSLSIIGNVQQQGTRITYDLANNLIGLSANQC

SEQ ID NO: 6994 - protein, 501 aa, Brassica napus
MAFTPLFSLLSVITLSLLLITTDASSRSLLPSHETTVLDVVSSLQQTQHILSLDPTLTSLTTTTITIPGSDPVFLNSSSPLSLELHSRDTLVASQHKDYKSLVLSRLERDSSRVAGITTKIRFAVEGIDRSDLKPVYNDETLYQPEDLTTPVVSGASQGSGEYFSRIGVGTPAKEMFMVLDTGSDINWIQCQPCSDCYQQSDPVFDPASSSTFKSLSCSAPQCGSLEVSACRSDKCLYQVSYGDGSFTVGDYATDTVTFGTNGKVNDVALGCGHDNEGLFTGAAGLLGLGGGALSMTNQIKATSFSYCLVDRDSGKSSSLDFNSVQAGTGDATAPLLRNSKIDTFYYVGLSGFSVGGQQVSIPSSVFAVDASGAGGVILDCGTAVTRLQTQAYNSLRDAFVKLTANLKKGTSSISLFDTCYDFSSLSTVKVPTVAFHFTGGKSIDLPAKNYLIPVDDAGTFCFAFAPTSSSLSIIGNVQQQGTRITYDLANNLIGLSANQC

SEQ ID NO: 6995 - protein, 491 aa, Brassica napus
MASARFLSLLSTVTLSLLLTTTDASSRSLPTSHETTVLDVVSSLQQTQHILSIDPTRSSLTTTTSAPESVPVFLNSSSPLSLELHSRDTLVASQHKDYKSLVLSRLERDSSRVAAIIAKVNLAVEGADSETRYQPEELTTPVISGASQGSGEYFSRLGVGTPAKEMYMVLDTGSDINWIQCKPCSSCYQQSDPIFDPSSSSTYKSLTCSAPQCASLRASACRSDKCLYQVRYGDGSFTVGEYATDTVTFGSSGKVDNVALGCGRDNEGLFTGAAGLLGLGGGALSMTSQIKAKSFSYCLVDRDSGKSSSLDFNSVQVGAGDATAPILRNSKIDTFYYVGFSGFSVGGQQVSIPSSAFAVDASGTGGVILDCGTAVTRLQTQAYNSLRDAFVKLTANLKRGTSSISLFDTCYDFSSLSTVKVPTVAFHFTGGKTLNLPAKNYLIPIDDAGTFCFAFAPTSSSLSIIGNVQQQGTRITYDLANHLIGLSANKC

SEQ ID NO: 6996 - protein, 491 aa, Brassica rapa
MASARFLSLLSTVTLSLLLTTTDASSRSLPTSHETTVLDVVSSLQQTQHILSIDPTRSSLTTTTTTPESVPVFLNSSSPLSLELHSRDTLVASQHKDYKSLVLSRLERDSSRVASIIAKVNLAVEGADSETRYNPEELTTPVISGASQGSGEYFSRLGVGTPAKEMYMVLDTGSDINWIQCKPCSSCYQQSDPIFDPSSSSTYKSLTCSAPQCASLRASACRSDKCLYQVRYGDGSFTVGEYATDTVTFGSSGKVDNVALGCGRDNEGLFTGAAGLLGLGGGALSMTSQIKAKSFSYCLVDRDSGKSSSLDFNSVQVGAGDATAPILRNSKIDTFYYVGFTGFSVGGQQVSIPSSAFAVDASGTGGVILDCGTAVTRLQTQAYNSLRDAFVKLTANLKRGTSSISLFDTCYDFSSLSTVKVPTVAFHFTGGKTLNLPAKNYLIPIDDAGTFCFAFAPTSSSLSIIGNVQQQGTRITYDLANHLIGLSANKC

SEQ ID NO: 6997 - protein, 491 aa, Brassica napus
MASARFLSLLPIVTLSLLLTTTDASSRSLPTSHETTVLDVVSSLQQTQQILSIDPTRSSLTTTTAAKESIPVFLNSSSPLSLELHSRDTLVASQHKNYKSLVLSRLERDSSRVASIIAKVKLAVEGADSETHYQPEELTTPVISGASQGSGEYFSRLGVGTPAKEMYMVLDTGSDINWIQCKPCSSCYQQSDPIFDPSSSSTYKSLTCSAPQCASLRASACRSDKCLYQVRYGDGSFTVGEYATDTVTFGSSGKVDNVALGCGRDNEGLFTGAAGLLGLGGGALSMTSQIKAKSFSYCLVDRDSGKSSSLDFNSVQVGAGDATAPILSNSKIDTFYYVGFTGFSVGGQQVSIPSSAFAVDASGTGGVILDCGTAVTRLQTQAYNSLRDAFVKLTANLKRGTSSISLFDTCYDFSSLSTVKVPTVAFHFTGGKTLNLPAKNYLIPIDDAGTFCFAFAPTSSSLSIIGNVQQQGTRITYDLANHLIGLSANKC

SEQ ID NO: 6998 - protein, 500 aa, Arabidopsis lyrata
MAFPRFLSLLTTVTLSLFLTATDASSRSLSTSTKTTVLDVVSSLQQTQTILSLDPTRSSLTATKPESISDPVFFNSSSPLSLELHSRDTLVASQHKDYKSLVLSRLERDSSRVAGIAAKIRFAVEGIDRSDLKPVNNEDTRYQPEALTTPVVSGVSQGSGEYFSRIGVGTPAKEMYLVLDTGSDVNWIQCEPCSDCYQQSDPVFNPTSSSTYKSLTCSAPQCSLLETSACRSNKCLYQVSYGDGSFTVGELATDTVTFGNSGKINDVALGCGHDNEGLFTGAAGLLGLGGGALSITNQMKATSFSYCLVDRDSGKSSSLDFNSVQLGSGDATAPLLRNQKIDTFYYVGLSGFSVGGQKVMMPDAIFDVDASGSGGVILDCGTAVTRLQTQAYNSLRDAFLKLTTNLKKGTSSISLFDTCYDFSSLSSVKVPTVAFHFTGGKSLDLPAKNYLIPVDDNGTFCFAFAPTSSSLSIIGNVQQQGTRITYDLANKIIGLSGNKC

SEQ ID NO: 6999 - protein, 489 aa, Brassica napus
SARFLSLLPIVTLSLLLTTTDASSRSLPTSHETTVLDVVSSLQQTQQILSIDPTRSSLTTTTAAKESIPVFLNSSSPLSLELHSRDTLVASQHKNYKSLVLSRLERDSSRVASIIAKVKLAVEGADSETHYQPEELTTPVISGASQGSGEYFSRLGVGTPAKEMYMVLDTGSDINWIQCKPCSSCYQQSDPIFDPSSSSTYKSLTCSAPQCASLRASACRSDKCLYQVRYGDGSFTVGEYATDTVTFGSSGKVDNVALGCGRDNEGLFTGAAGLLGLGGGALSMTSQIKAKSFSYCLVDRDSGKSSSLDFNSVQVGAGDATAPILSNSKIDTFYYVGFTGFSVGGQQVSIPSSAFAVDASGTGGVILDCGTAVTRLQTQAYNSLRDAFVKLTANLKRGTSSISLFDTCYDFSSLSTVKVPTVAFHFTGGKTLNLPAKNYLIPIDDAGTFCFAFAPTSSSLSIIGNVQQQGTRITYDLANHLIGLSANKC

SEQ ID NO: 7000 - protein, 500 aa, Arabidopsis thaliana [sequence omitted]

SEQ ID NO: 7001 - protein, 498 aa, Brassica napus
MAFARFFSLLTVITLSLFLLASNASSRSLSTPHKTTVLNVVSSLQQTQHILSIDPTTTTRPEFESKSIPFFLNSSSPLTLELHSRDTLLAPHHKDYKSLVLSRLERDSSRVAGIAAKVRFSVEGVDRSDLKPVYNDETMYNPEELTTPVVSGASQGSGEYFSRIGVGTPAKEMYMVLDTGSDVNWLQCKPCSDCYEQSDPVFDPAESSTYKPLTCAAPQCASLEVSTCRSNKCLYQVSYGDGSFTVGEYATDTVTFGDSGKVNDVALGCGHDNEGLFMGAAGLLGLGGGALSMTNQINATSFSYCLVDRDSGNSSSLDFNSVQIGDGDATAPLLLNKKIDTFYYVGLSGFSVGGEKVEIPSSVFEVDAAGAGGVILDCGTAVTRLQTEAYNALRDAFVKLAKDFKNATSSISLFDTCYDFSSMSSVNVPTVAFHFTGGKSIDLPAKNYLIPIDDAGTFCFAFAPTSSELSIIGNVQQQGTRITYNLENNLIGLSANKC

SEQ ID NO: 7002 - protein, 499 aa, Brassica napus
MAFARFFSLLTVITLSLFLLASNASSRSLSTPHKTTVLNVVSSLQQTQHILSIDPTTTTRPEFESKSIPFFLNSSSPLTLELHSRDTLLAPHHKDYKSLVLSRLERDSSRVAGIAAKVRFSVEGVDRSDLKPVYNDETMYNPEELTTPVVSGASQGSGEYFSRIGVGTPAKEMYMVLDTGSDVNWLQCKPCSDCYEQSDPVFDPAESSTYKPLTCAAPQCASLEVSTCRSNKCLYQVSYGDGSFTVGEYATDTVTFGDSGKVNDVALGCGHDNEGLFMGAAGLLGLGGGALSMTNQINATSFSYCLVDRDSGNSSSLDFNSVQISDGDATAPLLRNKKIDTFYYVGLSGFSVGGEKVEIPSSVFEVDDATGAGGVILDCGTAVTRLQTEAYNALRDAFVKLAKDFKNATSSISLFDTCYDFSSMSSVNVPTVAFHFTGGKSIDLPAKNYLIPIDDAGTFCFAFAPTSSELSIIGNVQQQGTRITYNLENNLIGLSANKC

SEQ ID NO: 7003 - protein, 250 aa, Brassica napus
MFMVLDTGSDINWIQCQPCSDCYQQSDPVFDPASSSTFKSLSCSAPQCGSLEVSACRSDKCLYQVSYGDGSFTVGDYATDTVTFGTNGKVNDVALGCGHDNEGLFTGAAGLLGLGGGALSMTNQIKATSFSYCLVDRDSGKSSSLDLNSVQAGTGDATAPLLRNSKIDTFYYVGLSGFGVGGQQVSIPSSVFAVDASGAGGVILDCGTAVTRLQTQAYNSLRDAFVKLTANLKKGTSSISLFDTCYDFSS

SEQ ID NO: 7004 - protein, 243 aa, Brassica napus
GRLRTGPEFWVDNASGPLSPCPSLLLGNFVERIKDACHFLVSAVLGTIISAVLTFFFSLVGTLLGALTGALIGQETESGFIRGAAIGAITGAVFSIEVFESSLDLWKSDESCFGCLLYLIDVIVSLLSGRLVRERIGPAMLSAVQSQMGALDAPYDDLSSLFETGGAKGLTGDLVEKIPKLTITDNNNTDASENRDSCSVCLQDFQLGETVRSLPHCHHMFHLPCIDKWLLRHGSCPMCRHDL

SEQ ID NO: 7005 - protein, 242 aa, Raphanus sativus
  misc_feature (25)..(25): Xaa can be any naturally occurring amino acid
GPENMASYYRFQSGFCPLSPCPSLXDNFVERIKDACHFLVSAVLGTIVSVILTFFFSLVGTLLGALTGALIGQETESGFIRGAAIGAISGAVFSIEVFESSLDLWKSDESCFGCLLYLIDVIVSLLSGRLVRERIGPAMLSAVQSQMGALDASYDDLSSLFETGGPKGLTGDLVEKIPKLTITGNNNTDASESRDSCSVCLQDFQLGETVRSLPHCHHMFHLPCIDKWLLRHGSCPMCRRDL

SEQ ID NO: 7006 - protein, 239 aa, Arabidopsis lyrata
MASSSSYRFQSGFCPLSSSPSLGNFVERIKDACHFLVSAVLGTIISAILTFFFALVGTLLGALTGALIGQETESGFIRGAAIGAISGAVFSIEVFESSLDLWKSDESGFGCFLYLIDVIVSLLSGRLVRERIGPAMLSAVQSQMGAVDAAFDDHTSLFDTGGSKGLTGELVEKIPKMTITGNNNTDASENRDPCSVCLQDFQLGETVRSLPHCHHMFHLPCIDNWLLRHGSCPMCRRDL

SEQ ID NO: 7007 - protein, 241 aa, Arabidopsis thaliana
MASSSSSSYRFQSGSYPLSSSPSLGNFVERIKDACHFLVSAVLGTIISAILTFFFALVGTLLGALTGALIGQETESGFIRGAAIGAISGAVFSIEVFESSLDLWKSDESGFGCFLYLIDVIVSLLSGRLVRERIGPAMLSAVQSQMGAVDTAFDDHTSLFDTGGSKGLTGDLVEKIPKMTITGNNNTDASENTDSCSVCLQDFQLGETVRSLPHCHHMFHLPCIDNWLLRHGSCPMCRRDI

SEQ ID NO: 7008 - protein, 237 aa, Brassica napus
MASSSRSQSGFCPLSPCPSLGNFVERIKDACRFLVSAVLGTVLSAILTFFFALVGTLLGAVTGALIGQETESGFIRGAAVGAISGAVFSIEVFESSLVLWKSNESRFGCLLYLIDVIVSLISGRLVRERIGPAMLSAVQSQMGAVDATFDELSSIFDTGGSKGLTGDMVNKIPKIKITGKNNLDASGNKDSCSVCLQDFQLGETVRSLPQCHHMFHLPCIDNWLLRHGSCPMCRRDL

SEQ ID NO: 7009 - protein, 237 aa, Brassica napus
MASSSRSQSGFCPLSPCPSLGNFVERIKDACRFLVSAVLGTVLSAILTFFFALVGTLLGAVTGALIGQETESGFIRGAAVGAISGAVFSIEVFESSLVLWKSNESRFGCLLYLIDVIVSLISGRLVRERIGPAMLSAVQSQMGAVDATFDELSSIFDTGGSKGLTGDMVNKIPKIKITCKNNLDASGNKDSCSVCLQDFQLGETVRSLPQCHHMFHLPCIDNWLLRHGSCPMCRRDL

SEQ ID NO: 7010 - protein, 237 aa, Brassica napus
MASYRSQSELCPLSPCPSLGNFVERIKDACRFLVSAVLGTVLSAILTFFFALVGTLLGAVTGALIGQETESGFIRGAAVGAISGAVFSIEVFESSLLLWKSNESRFGCLLYLIDVIVSLISGRLVRERIGPAMLSAVQSQMGPADAATFDDLSSIFDTGGSKGLTVDVVDKIPKIKITGGNNLDASGNKDSCSVCLQDFQLGETVRSLPHCHHMFHLPCIDNWLLRHGSCPMCRRDL

SEQ ID NO: 7011 - protein, 236 aa, Arabidopsis lyrata
MASSRFQSGFCPISSCPSLGNFVERIKDACRFTLSAVLGTILSAILTFFFALVGTLLGALTGALIGQETESGFIRGAAVGAISGAVFSIEVFESSLVLWKSNESRFGCLLYLIDVIVSLISGRLVRERIGPAMLSAVQSQMGAVDTTFEELSSIFDTGGSKGLTGDLVDKIPKIKITGKNNLDASGNKDSCSVCLQDFQLGETVRSLPHCHHMFHLPCIDNWLFRHGSCPMCRRDL

SEQ ID NO: 7012 - protein, 232 aa, Brassica napus
MASYRSQSELCPLSPCPSLGNFVERIKDACRFLVSAVLGTILSAILTFFFALVGTLLGAVTGALIGQETESGFIRGAAVGAISGAVFSIEVFESSLLLWKSNESRFGCLLYLIDVIVSLISGRLVRERIGPAMLSAVQSQMGAADATFDDLSSIFDTGGSKGLTVDVVDKIPKIIITGDASGNKDSCSVCLQDFQLGETARSLPHCHHMFHLPCIDNWLLRHGSCPMCRRDL

SEQ ID NO: 7013 - protein, 236 aa, Arabidopsis thaliana
MASSRFQSGFCPISSCPSLENFIERIKDACRFTLSAVLGTILSAVLTFFFALVGTLLGALTGALIGQETESGFIRGAAVGAISGAVFSIEVFESSLVLWKSNESRFGCLLYLIDVIVSLISGRLVRERIGPAMLSAVQSQMGAVDSTFEELSSIFDTGGSKGLTGDLVDKIPKIKITGKNNLDASGNKDSCSVCLQDFQLGETVRSLPHCHHMFHLPCIDNWLFRHGSCPMCRRDL

SEQ ID NO: 7014 - protein, 236 aa, Raphanus sativus
  misc_feature (144)..(144): Xaa can be any naturally occurring amino acid
  misc_feature (167)..(167): Xaa can be any naturally occurring amino acid
MASYRSQPVGCTLSPCPYLGNFVERIKDACRFLVSAVLGTVLSAILTFFFALVGTLLGAVTGALIGQETESGFIRGAAVGAISGAVFSIEVFESSLLLWKSNESRFGCLLYLIDVIVSLISGRLVRERIGPAMLSAVQSQMGAXDATFDDLSSIFDTGGSKGLTVDXVDKIPKIIITGRNSLDASGNKDSCSVCLQDFQLGETVRSLPHCHHMFHLPCIDNWLLRHGSCPMCRRDL

SEQ ID NO: 7015 - protein, 200 aa, Brassica rapa
  misc_feature (137)..(137): Xaa can be any naturally occurring amino acid
  misc_feature (191)..(191): Xaa can be any naturally occurring amino acid
MASYRSQSELCPLSPCPSLGNFVERIKDACRFLVSAVLGTVLSAILTFFFALVGTLLGAVTGALIGQETESGFIRGAAVGAISGAVFSIEVFESSLLLWKSNESRFGCLLYLIDVIVSLISGRLVRERIGPAMLSAXQSQMGPADAATFDDLSSIFDTGGSKGLTVDVVDKIPKIKITGGNNLDASGNKDXCSVCLQDFS

SEQ ID NO: 7016 - protein, 234 aa, Raphanus sativus
  misc_feature (17)..(17): Xaa can be any naturally occurring amino acid
MASSSSRSQSEFCPLSXCPSIERIKDACRFLVSAVLGTILSAILTFFFALVGTLLGAVTGALIGQETESGFIRGAAVGAISGAVFSIEVFESSLVLWKSNESRFGCLLYLIDVIVSLISGRLVRERIGPAMLSAVQSQMGAVDATFDELSSIFDTGGSKGLTRDTVDQIPKIKITGRNNLDASGDEYSCSVCLQDFQLGETVRSLPQCHHMFHLPCIDNWLLRHGSCPMCRRDL

SEQ ID NO: 7017 - protein, 250 aa, Brassica rapa
WLSELCFLPENMASYYRFQSGFCPLSPCPSLLLGNFGRTDQRRLSFPRLRCSWHHHLRRLDLLLLPSGHIVRGTYRSLIGQETESGFIRGAAIGAITGAVFSIEVFESSLDLWKSDESCFGCLLYLIDVIVSLLSGRLVRERIGPAMLSAVQSQMGALDAPYDDLSSLFETGGAKGLTGDLVEKIPKLTITDNNNTDASENRDSCSVCLQDFQLGETVRSLPHCHHMFHLPCIDKWLLRHGSCPMCRHDL

SEQ ID NO: 7018 - protein, 125 aa, Unknown
  Sequence found in Organisms: Brassica napus, Brassica juncea, Brassica rapa
MAGRLSGVASRIMGGNGVVARSGASSLRQRAGMGLPVGKHIVPDKPLSVNDELMWDNGTAFPEPCIDRIADTVGKYEALGWLCGGLGFFATLGLLAVVNDKASKVPFTPRVYPYDNLRVELGGEP

SEQ ID NO: 7019 - protein, 125 aa, Unknown
  Sequence found in Organisms: Brassica napus, Brassica juncea, Raphanus sativus
MAGRLSGVASRIMGGNGVVARSNASSLRQRAGMGLPVGKHIVPDKPLSVNDELMWDNGTAFPEPCIDRIADTVGKYEALGWLCGGLGFFATLGLLAVVNDKASKVPFTPRVYPYDNLRVELGGEP

SEQ ID NO: 7020 - protein, 125 aa, Raphanus sativus
MAGRLSGVASRIMGGNGIVARSAASSLRQRAGMGLPVGKHIVPDKPLSVNDELMWDNGTAFPEPCIDRIADTVGKYEALGWLCGGLGFFATLGLLAVVNDKASKVPFTPRVYPYDNLRVELGGEP

SEQ ID NO: 7021 - protein, 125 aa, Thellungiella halophila
MAGRLSGVASRIMGGNGVVARSAASSLRQRAGMGLPVGKHIVPDKPLSVNDELMWDNGTAFPEPCIDRIADTVGKYEALGWLCGGLGFFATLGLLAVLNDKASKVPFTPRVYPYDNLRVELGGEP

SEQ ID NO: 7022 - protein, 125 aa, Brassica juncea
MAGRLSGVASRLMGGNGVVARSNASSLRQRAGMGLPVGKHIVPDKPLSVNDELMWDNGTAFPEPCIDRIADTVGKYEALGWLCGGLGFFATLGMLAVLNDKASKVPFTPRVYPYDNLRVELGGEP

SEQ ID NO: 7023 - protein, 125 aa, Brassica napus
MAGRLSGVASRIMGGNGVVARSNASSLRQRAGMGLPVGKHIVPDKPLSVNDELMWDNGTAFPEPCIDRIADTVGKYEALGWLCGGLGFFATLGLLAVVNDKASKVPFAPRVYPYDNLRVELGGEP

SEQ ID NO: 7024 - protein, 125 aa, Unknown
  Sequence found in Organisms: Brassica napus, Brassica oleracea
MAGRLSGVASRIMGGNGVVARSAASSLRQRAGMGLPVGKHIVPDKPLSVNDELMWDNGTAFPEPCIDRIADTVGKYEALGWLCGGLSFFAALGMLAVLNDKASKVPFTPRVYPYDNLRVELGGEP

SEQ ID NO: 7025 - protein, 125 aa, Brassica oleracea
  misc_feature (18)..(18): Xaa can be any naturally occurring amino acid
MAGRLSGVASRIMGGNGXVARSNASSLRQRAGMGLPVGKHIVPDKPLSVNDELMWDNGTAFPEPCIDRIADTVGKYEALGWLCGGLGFFATLGLLAVVNDKASKVPFTPRVYPYDNLRVELGGEP

SEQ ID NO: 7026 - protein, 125 aa, Brassica napus
MAGRLSGVASRLMGGNGVVARSNASSLRQRAGMGLPVGKHIVPDKPLSVNDELMWDNGTAFPEPCIDRIADTVGKYEALGWLCGGLGFFATLGLLAVVNDKASKVPFTPRVYPYDNLRVELGGEP

SEQ ID NO: 7027 - protein, 125 aa, Raphanus sativus
  misc_feature (9)..(9): Xaa can be any naturally occurring amino acid
MAGRLSGVXSRIMGGNGIVARSAASSLRQRAGMGLPVGKHIVPDKPLSVNDELMWDNGTAFPEPCIDRIADTVGKYEALGWLCGGLGFFATLGLLAVVNDKASKVPFTPRVYPYDNLRVELGGEP

SEQ ID NO: 7028 - protein, 125 aa, Raphanus sativus
MAGRLSGVASRIMGRNGVVSRSGASSLRQRAGMGLPVGKHIVPDKPLSVNDELMWDNGTAFPEPCIDRIADTVGKYEALGWLCGGLGFFATLGMLAVVNDKASKVPFTPRVYPYDNLRVELGGEP

SEQ ID NO: 7029 - protein, 125 aa, Brassica juncea
MAGRLSGVASRIMGGNGVVARSNASSLRQRAGMGLPVGKHIVPDKPLSVNDELMWDNGTAFPEPCIDRIADTVGKYEALGWLCGGLSFFAGLGMLAVLNDKASKVPFTPRVYPYDNLRVELGGEP

SEQ ID NO: 7030 - protein, 125 aa, Brassica rapa
MAGRLSGVASRLMGGNGVVARTNASSLRQRAGMGLPVGKHIVPDKPLSVNDELMWDNGTAFPEPCIDRIADTVGKYEALGWLCGGLGFFATLGLLAVVNDKASKVPFTPRVYPYDNLRVELGGEP

SEQ ID NO: 7031 - protein, 125 aa, Brassica napus
MAGRLSGVASRIMGGNGIVARSAASSLRQRAGMGLPVGKHIVPDKPLSVNDELMWDNGTAFPEPCIDRIADTVGKYEALGWLCGGLSFFAGLGMLAVLNDKASKVPFTPRVYPYDNLRVELGGEP

SEQ ID NO: 7032 - protein, 125 aa, Brassica rapa
MAGRLSGVASRIMGGNGIVARSAASSLRQRAGMGLPVGKHIVPDKPLSVNDELMWDNGTAFPEPCIDRIADTVGKYEALGWLCGGLSFFGALGMLAVLNDKASKVPFTPRVYPYDNLRVELGGEP

SEQ ID NO: 7033 - protein, 125 aa, Arabidopsis lyrata
MAGRLSGVASRIMGGNGVVARSVGSSLRQRAGMGLPVGKHIVPDKPLSVNDELMWDNGTAFPEPCIDRIADTVGKYEALAWLSGGLGFFAGLGLLAVLNDKASKVPFTPRVYPYDNLRVELGGEP

SEQ ID NO: 7034 - protein, 130 aa, Raphanus sativus
MAGRLSGVASRIMGGNGVVARSNASSLRQRAGMGLPVGKHIVPDKPLSVDDELMWDNGTAFPEPCIDRIADTVGKYEALGWLCGGLGFFATLGLLAVVNDKASKVPFTPRVYPYDNLRVELGGEPLRPIK

SEQ ID NO: 7035 - protein, 125 aa, Arabidopsis thaliana
MAGRLSGVASRIMGGNGVVARSVGSSLRQRAGMGLPVGKHIVPDKPLSVNDELMWDNGTAFPEPCIDRIADTVGKYEALAWLSGGLGFFVGLGLLAVLNDKASKVPFTPRVYPYDNLRVELGGEP

SEQ ID NO: 7036 - protein, 125 aa, Cleome spinosa
MAGRLSGVASRIMGGNGVVARSVGSSLRQRAGMGLPVGKHIVPDKPLPVNDELVWDNGTAFPEPCVDRIADTVGKYEALGWLCGGLGFFVTLGLAAVWNDKASKIPFTPKVYPYDNLRVELGGEP

SEQ ID NO: 7037 - protein, 125 aa, Eucalyptus gunnii
MAGRLSHVASRIMGGNGVVARSAASSLRLRAGMGLPVGKHIVPDKPLHVNDELVWDNGTAFPEPCIDRIADTVGKYEALAWLCGGLGFFASLGLLAVWNDKASKIPFAPKVYPYDNLRVELGGEP

SEQ ID NO: 7038 - protein, 125 aa, Carica papaya
MAGRLSTVASRIMGGNGVVSRSVASSLRLRSGMGLPVGKHIVPDKPLPVNDELVWDNGTAFPEPCIDRIADTVGKYEALAWLCGGLGFFASLGLLAVWNDRASKVPFTPRVYPYDNLRVELGGEP

SEQ ID NO: 7039 - protein, 125 aa, Cleome spinosa
MAGRLSGVASRIMGGNGVIARSVGSSIRLRAGMGLPVGKHIVPDKPLPVNDELVWDNGTAFPEPCVDRIADTVGKYEALGWLCGGLGFFATLGLAAVWNDKASKIPFTPKVYPYDNLRVELGGEP

SEQ ID NO: 7040 - protein, 125 aa, Sesamum indicum
MAGRLSHVASRIMGGNGIVSRSAAASLRQRSGMGLPVGKHIVPDKPLPVNDELVWDNGTAFPEPCIDRIADTVGKYEALAWLCGGLGFFASLGFLAVWNDKASKIPFTPKVYPYDNLRVELGGEP

SEQ ID NO: 7041 - protein, 125 aa, Lactuca sativa
MAGRLSNVASQIMGGNGVVGRSVASSLRLRSGMGLPVGKHIVPDKPLPVNDELMWDNGTAFPEPCIDRIADTVGKYEALGWLCGGLGFFATLGLMATLNDKASKIPFTPKVFPYDNLRVELGGEP

SEQ ID NO: 7042 - protein, 125 aa, Rhizophora mangle
MAGRLSSVASRIMGGNGAVGRSIASSLRLRSGMGLPVGKHIVPDKPLPVNDELVWDNGTSFPEPCIDRIADTVGKYEALAWMCGGLGFFATLGLLAAWNDKASKVPFTPKVYPYDNLRVELGGEP

SEQ ID NO: 7043 - protein, 125 aa, Tragopogon dubius
MAGRLRNVASQIMGGNGVVGRSVASSLRLRSGMGLPVGKHIVPSKPLPVNDELMWDNGTAFPEPCIDRIADTVGKYEALGWLCGGLSFFATLGLLATLNDKASKIPFTPRVFPYDNLRVELGGEP

SEQ ID NO: 7044 - protein, 125 aa, Citrus sinensis
MAGRLSNVASQIMGGNGVVGRSVASSLRLRSGMGLPVGKHIVPNKPLSVNDELVWDNGTPFPEPCIDRIADTVGKYEALGWLLGGLGFFASLGALAVWNDKASKIPFTPKVYPYDNLRVELGGEP

SEQ ID NO: 7045 - protein, 125 aa, Lactuca sativa
MAGRLRNVASQIMGGNGVVGRSVASSLRLRSGMGLPVGKHIVPDKPLPVNDELMWDNGTAFPEPCIDRIADTVGKYEALGWLCGGLGFFATLGLMATLNDKASKIPFTPKVFPYDNLRVELGGEP

SEQ ID NO: 7046 - protein, 125 aa, Glycyrrhiza uralensis
MAGRLTNAASRILGGNGVVHRSVASSLRLRSGMGLPVGKHIVPDKPLSVNDELIWDNGTPFPEPCIDRIADTVGKYEALGWLCGGLGFFASLGLLAVWNDKASKIPFTPKVYPYDNLRVELGGEP

SEQ ID NO: 7047 - protein, 125 aa, Quercus alba
MAGRLSNVASRIMGGNGVVCRSVASSLRLRAGMGLPVGKHIVPDKPLPVNDELVWDNGTPFPEPCIDRIADTVGKYEALAWLCGGLSCFAGLGLLAVWNDKASKIPFAPKVYPYDNLRVELGGEP

SEQ ID NO: 7048 - protein, 125 aa, Salvia sclarea
MAGRLSHVASRIMGGNGVVSRSAASSLRQRSGMGLPVGKHLVPDKPLSVNDELVWDNGTPFPEPCIDRIADTVGKYEALAWLCGGLSFFVSLGALAVWNDKASTIPFAPKVYPYDNLRVELGGEP

SEQ ID NO: 7049 - protein, 125 aa, Bruguiera gymnorhiza
MAGRLSNVASRIMGGNGVVGRSVASSLRLRSGMGLPVGKHNVPDKPLPVNDELVWDNGTAFPEPCIDRIADTVGKYEALAWMCGGLGFFATLGLLAMWNDKASKVPFTPKVYPYDNLQVELGGEH

SEQ ID NO: 7050 - protein, 125 aa, Camellia sinensis
MAGRLSLVASRIMGGNGVASRSVASSLRLRSGMGLPVGKHIVPDKPLPVNDELVWDNGTAFPEPCIDRIADTVGKYEALAWLCGGLSFFAGLGLLAVWNDKASKNPFAPKVYPYDNLRVELGGEP

SEQ ID NO: 7051 - protein, 125 aa, Cleome gynandra
MAGRLSIVASRIMAGNALVSRSVASSLPHRAGMGLPVGKHIVPDKPLPVNDELVWDNGSAYPEPCIDRIADTIGKYEALGWLCGGLGFFATLGLLAVWNDKASKYPFTPKVYPYDNLRVELGGEP

SEQ ID NO: 7052 - protein, 124 aa, Camellia sinensis
AGRLSLVASRIMGGNGVASRSVASSLRLRSGMGLPVGKHIVPDKPLPVNDELVWDNGTAFPEPCIDRIADTVGKYEALAWLCGGLSFFAGLGLLAVWNDKASKNPFAPKVYPYDNLRVELGGEP

SEQ ID NO: 7053 - protein, 122 aa, Antirrhinum majus
MAGRLSHVASRILGGNGVVSRSSLRQRSGMGLPVGKHIVPDKPLHVNDELTWDNGTAFPEPCIDRIADTVGKYEALAWLCGGLGFFASLGLLAVWNDKASTIPFAPKVYPYDNLRVELGGEP

SEQ ID NO: 7054 - protein, 125 aa, Malus domestica
MAGRLSSVASKIMGGNGVVSRSVASSLRVRAGMGLPVGKHIVPDKPLPVNDELVWDNGTPFPEPCIDRIADTVGKYEALAWLCGGLSCFAGLGLLAVWNDKASKIPFAPKVYPYDNLRVELGGEP

SEQ ID NO: 7055 - protein, 125 aa, Manihot esculenta
MAGRLCNVASRIMGGNGVVSRSVASSLRLRSGMGLPVGKHIVPEKPLPVNDELVWDNGTPFPEPCIDRIADTVGKYEALAWLCGGLGFFASLGLLAVWNDKASKIPYTPKVYPYDNLRVELGGEP

SEQ ID NO: 7056 - protein, 125 aa, Centaurea maculosa
MAGRLSHAASQIMGGNGVVRRSVASSLRLRSGMGLPVGKHIVPDKPLPVNDELVWDNGTPFPEPCIDRIADTVGKYEALGWLCGGLSFFATLGLLATLNDKASKIPFAPKVYPYDNLRVELGGEP

SEQ ID NO: 7057 - protein, 125 aa, Vitis vinifera
MAGRLSNVASRIMGGNGVVSRSVASSLRLRSGMGLPVGKHIVPNKPLPVNDELIWDNGTPFPEPCIDRIAETVGKYEALAWMCGGLSFFASLGLLAVWNDKASKIPFTPRVYPYDNLRVELGGEP

SEQ ID NO: 7058 - protein, 125 aa, Populus trichocarpa
MAGRLSNVASRIMGGNGVVSRSVASSLRLRSGMGLPVGKHIVPDKPISVNDELTWDNGTAFPEPCIDRIADTVGKYEALAWLCGGLGFFASLGLLVVWNDKASTIPFAPKVYPYDNLKVELGGEP

SEQ ID NO: 7059 - protein, 125 aa, Unknown
  Sequence found in Organisms: Solanum tuberosum, Solanum phureja
MAGRLSNVATRIMGGNGVVARSVASSLRTRAGMGLPVGKHIVPDKPLHVNDELTWDNGTPFPEPCIDRIADTVGKYEALAWLCGGLSCFVGIGLLAVWNDKASKIPFTPKVYPYDNLRVELGGEP

SEQ ID NO: 7060 - protein, 125 aa, Solanum lycopersicum
MAGRLSNVATRIMGGNGVVARSLASSLRTRAGMGLPVGKHIVPDKPLHVNDELTWDNGTPFPEPCIDRIADTVGKYEALAWLCGGLSCFVGIGLLAVWNDKASKIPFTPKVYPYDNLRVELGGEP

SEQ ID NO: 7061 - protein, 125 aa, Acacia harpophylla
MAGRLTSAASRILGGNGVVGRSAVSSLRLRSGMGLPVGKHIVPDKPLPVNDELMWDNGTPFPEPCIDRIADTVGKYEALAWLCGGLGFFASLGLLVVWNDKASKIPFTPKVYPYDNLRVERGGEP

SEQ ID NO: 7062 - protein, 125 aa, Ipomoea nil
MAGRLSQAAAHIMGGRGVVARSVASSLRTRAGMGLPVGKHIVPDKPLPVNDELMWDNGTPFPEPCIDRIADTVGKYEALAWMCGGLGFFASLGLMAVWNDKASKIPFTPKVYPYDNLKVELGGEP

SEQ ID NO: 7063 - protein, 99 aa, Beta vulgaris
MAGRLSKVASSMLGGNGVVSRSVGNSLRQRAGMGLPVGKHIVPDKSLSVNDELTWDNGTSFPEPCIDRIADTVGKYEALAWLCGGIGVFRYTWISRCLE

SEQ ID NO: 7064 - protein, 125 aa, Castanea mollissima
MAGRLSNVASRIMGGNGVVYRSVASSLRLRSGLGLPVGKHIVPDKPLPVNDELVWDNGTPFPEPCIDRIADTVGKYEALAWLCGGLSCFAGLGLLAVWNDKASKIPFAPKVYPYDNLRVELGGEP

SEQ ID NO: 7065 - protein, 125 aa, Gossypium hirsutum
MAGRLSNVASKIMGGNGIVSRSAASSLRLRSGMGLPVGKHIVPDKPLPVNDELIWDNGTAFPEPCIDRIADTVGKYEALAWMCGGLSFFASLGFLAWWNDKASKIPFAPKVYPYDNLRVELGGEP

SEQ ID NO: 7066 - protein, 125 aa, Nicotiana benthamiana
MAGRLSNAAARIMGGNGVVARSVASSLRLRAGMGLPVGKHIVPDKPLGVNDELTWDNGTPFPEPCIDRIADTVGKYEALAWLSGGLSFFVGLGLLAVWNDKASTIPFTPKVYPYDNLRVELGGEP

SEQ ID NO: 7067 - protein, 125 aa, Prunus persica
MAGRLSSVASKIMGGNGVVSRSVASSLRLRAGMGLPVGKHIVPNRPLHVNDELVWDNGTPFPEPCIDRIADTVGKYEALAWLCGGLSFFASLGLLAVWNDKASKIPFAPKVYPYDNLRVELGGEP

SEQ ID NO: 7068 - protein, 122 aa, Senecio madagascariensis
MAGRLASQIMSGNGVVYRSAAASLRLRSGMGLPVGKHIVPDKPLPVNDELVWDNGTAFPEPCIDRIADTVGKYEALGWLCGGLGFFATLGLMATLNDKASKIPFAPKVYPYDNLRVELGGEP

SEQ ID NO: 7069 - protein, 99 aa, Nicotiana tabacum
MAGRLSNAAARIMGGNGVVARSVASSLRTRAGMGLPVGKHIVPDKPLGVNDELTWDNGTPFPEPCIDRIADTVGKYEALAWLSGGLSFFRGAWAVSCLE

SEQ ID NO: 7070 - protein, 126 aa, Juglans hindsii x Juglans regia
MAGRLGNMASRIMGGNGVVCRSAASSLRLRSGMGLPVGKHIVPDKPVPVNDELIWDNGTPYPEPCIDRIADTVGKYEALAWLCGGLSFFASLGLLAVWNDKASKTPFTPKVYPYDNLRVELGGEPS

SEQ ID NO: 7071 - protein, 125 aa, Taraxacum officinale
MAGRLRNVASQIMGGNGVVGRSVASSLRLRSGMGLPVGKHIVPDKPLPVNDELVWDNGTAFPEPCIDRIADTVGKYEALAWLCGGLSFFATLGLMATLNDKASKIPFTPKVFPYDNLRVELGGEE

SEQ ID NO: 7072 - protein, 125 aa, Helianthus annuus
MAGRLSHVASQIMAGNGVVSRSGASSLRLRSGMGLPVGKHIVPDKPLPINDELVWDNGTPFPEPCIDRIADTVGKYEALGWLCGGLGFFATLGLMATLNDKASKIPYTPKVFPYDNLRVELGGEP

SEQ ID NO: 7073 - protein, 125 aa, Gossypium hirsutum
MAGRLSNVASRIMGGTGVVSRSVASSFRLRSGMGLPVGKHIVPDKPLPVNDELIWDNGTAFPEPCIDRIADTVGKYEALAWMCGGLSFFASLGFLAWWNDKASKIPFAPKVYPYDNLRVELGGEP

SEQ ID NO: 7074 - protein, 125 aa, Cynara scolymus
MAGRLSHAASQIMGGNGVVGRSVASSLRLRSGMGLPVGKHIVPDRPLPVNDELVWDNGTPFPEPCIDRIAETVGKYEALGWLCGGLGFFATLGLLATWNDKASKIPFAPKVFPYDNLRVELGGEP

SEQ ID NO: 7075 - protein, 125 aa, Liriodendron tulipifera
  misc_feature (24)..(24): Xaa can be any naturally occurring amino acid
  misc_feature (35)..(35): Xaa can be any naturally occurring amino acid
  misc_feature (103)..(103): Xaa can be any naturally occurring amino acid
MAGNLSRVASRIMGGNGVVGRSVXSSLRLRAGMGXPVGNHIVPDKPLPVNDELVWDNGTPFPEPCIDRLAPTIGKYEALGWLCGGLGFFATLGLLAVWNDKAXKIPFTPKVYPYDNLRVELGGEP

SEQ ID NO: 7076 - protein, 125 aa, Mimulus guttatus
MAGRLSHVASRIMGGNGVVQRSVATSLRQRSGMGLPVGKHLVPDKPLPVNDELVWDNGTPFPEPCIDRIADTVGKYEALAWLCGGLSCFAGLGLLAVWNDKASTIPFAPKVYPYDNLRVELGGEP

SEQ ID NO: 7077 - protein, 125 aa, Capsicum annuum
MAGRLSNAATRIMGGNGVVSRAVASSLRTRAGMGLPVGKHIVPDKPLQVNDELIWDNGTPFPEPCIDRIADTVGKYEALAWLCGGLSCFAGIGLLAVWNDKASKIPFTPKVYPYDNLRVELGGEP

SEQ ID NO: 7078 - protein, 125 aa, Petunia hybrida
MAGRLSSAAVRIMGGNGVVARSVGSSLRTRAGMGLPVGKHIVPDKPLAVNDELIWDNGTPFPEPCIDRIADTVGKYEALAWLSGGLSFFVGLGLLAVWNDKASKIPFAPKVYPYDNLRVELGGEP

SEQ ID NO: 7079 - protein, 125 aa, Nicotiana tabacum
MAGRLSNAAVRIMGGNGVVARSVVSSLRTRAGMGLPVGKHIVPDKPLGVNDELTWDNGTPFPEPCIDRIADTVGKYEALAWLSGGLSFFVGLGLLAVWNDKASTIPFTPKVYPYDNLRVELGGEP

SEQ ID NO: 7080 - protein, 125 aa, Triphysaria pusilla
MAGRLSQVASRIMGGSGVVSRSVGSSIRQRSGMGLPVGKHIVPDKPLPVNDELVWDNGTPFPEPCIDRIADTVGKYEALAWLSGGLGFFVGLGLLAVWNDKASKIPFAPKVYPYDNLRVELGGEP

SEQ ID NO: 7081 - protein, 125 aa, Coffea canephora
MAGRLSHMASRIMGGNGVVARSVGSSLRLRSGMGLPVGKHIVPDKPLPVNDELVWDNGTPFPEPCIDRIAETVGKYEALAWMCGGLGFFASLGLLAVWNDKASKIPYTPKVYPYDNLRAELGEEP

SEQ ID NO: 7082 - protein, 54 aa, Taraxacum officinale
MAGRLRNVASQIMGGNGVVGRSAASSLRLRSGMGLPVGKHIVPDKPLPVNDELV

SEQ ID NO: 7083 - protein, 125 aa, Solanum melongena
MAGRFFNAATRIMGGNGVVARSVGSSLRTRAGMGLPVGKHIVPDKPLQVNDELIWDNGTPFPEPCVDRIADTVGKYEALAWLCGGLSCFAGLGLLAVWNDKASKIPFTPKVYPYDNLRVELGGEP

SEQ ID NO: 7084 - protein, 125 aa, Centaurea maculosa
MAGRLSHAAAQIMGGNGVVRRSVASSLRLRSGMGLPVGKHIVPDKPLPINDELVWDNGTPFPEPCIDRIADTVGKYEALGWLCGGLSFFATLGLLATLNDKASKIPFAPKVFPYDNLRVELGGEP

SEQ ID NO: 7085 - protein, 125 aa, Gossypium hirsutum
MAGRLSNVASRIMGGTGVVSRSVASSFRLRSGMGLPVGKHIVPDKPLPVNDELIWDNGTAFPEPCIDRIADTVGKYEALAWMCGGLSFFASLGFLAWWNDKASKIPFAPKVYPYDSLRVELGGEP

SEQ ID NO: 7086 - protein, 125 aa, Unknown
  Sequence found in Organisms: Glycine max, Vigna unguiculata
MAGRLTNAASRILGGNGVVYRSVASSLRLRSGMGLPVGKHYVPDKPLPMNEELLWDNGTAFPEPCIDRIADTVGKYEALAWLCGGLSFFASLGLLAVWNDKASKIPFTPKVYPYDNLRVELGGEP

SEQ ID NO: 7087 - protein, 125 aa, Petunia hybrida
MAGRLSSAAVRIMGGNGVVARAVGSSLRTRAGMGLPVGKHIVPDKPLAVNDELIWDNGTPFPEPCIDRIADTVGKYEALAWLSGGLSFFVGLGLLAVWNDKASKIPFAPKVYPYDNLRVELGGEP

SEQ ID NO: 7088 - protein, 125 aa, Triphysaria pusilla
MAGRLSQVASRIMGGSGVVSRSVGSSIRQRSGMGLPVGKHIVPNKPLPVNDELVWDNGTPFPEPCIDRIADTVGKYEALAWLSGGLGFFVGLGLLAVWNDKASKIPFAPKVYPYDNLRVELGGEP

SEQ ID NO: 7089 - protein, 129 aa, Actinidia deliciosa
MAGRLSHIASQIMGGNGVVSRSVANSLRIRAGMGLPVGNHIVPDKPLPVNDELVWDNGTPFPEPCIDRIADTVGKYEALAWLCGGLSFFASLGLLAVWNDKASKIPFTPRVYPYDNLRVELGGEPEASG

SEQ ID NO: 7090 - protein, 122 aa, Artemisia annua
MAGRLASQIMGENGVVRRSVTSSLRLRSGMGMPVGKHIVPDKPLPVNDELVWDNGTSFPEPCIDRIADTVGKYEALGWLCGGLGFFATLGLMATLNDKASKIPFVPKVYPYDNLRVELGGEP

SEQ ID NO: 7091 - protein, 125 aa, Ipomoea batatas
MVGRLSQAAAHIMGGRGLVARSVASSLRTRAGMGLPVGKHIVPDKPLPVNDELMWDNGTPFPEPCVDRIADTVGKYEALAWLCGGLGFFASLGLLAVWNDKASKIPYTPKAYPYDNLKVELGGEP

SEQ ID NO: 7092 - protein, 125 aa, Triphysaria pusilla
MAGRLTQVASRIMGGSGVVSRSVGSSLRQRSGMGLPVGKHIVPNKPLPVNDELVWDNGTPFPEPCIDRIADTVGKYEALAWLSGGLGFFVSLGLLAVWNDKASKIPFAPKVYPYDNLRVELGGDP

SEQ ID NO: 7093 - protein, 125 aa, Phaseolus coccineus
MAGRLTNAASRILGGNGVVYRSVASSLRLRSGMGLPVGKHYVPDKPLPMNEELLWDNGTAFPEPCIDRIADTVGKYEALAWLCGGLSCFASLGLLAVWNDKASKIPFTPKVYPYDNLRVELGGEP

SEQ ID NO: 7094 - protein, 144 aa, Ricinus communis
LRNLRERRQSTGDERKKKKAAGRLSNVASRIMGGNGVVSRSIGSSLRLRSGMGLPVGKHIVPDKPLPVNEELVWDNGTPFPEPCIDRIADTVGKYEALAWLCGGLSFFASLGLLAVWNDKASKIPYVPKVYPYDNLRAELGGEP

SEQ ID NO: 7095 - protein, 125 aa, Elaeis guineensis
MAGRLSSVGSRIMGGNGVVGRSLVSSLRTRSGMGLPVGKHIVPDKPLPVHDELVWDNGTPYPEPCVDRLAPTIGKYEALGWLCGGLGFFATLGLLAVWNDKASKIPYTPKVYPYDNLRVELGGEP

SEQ ID NO: 7096 - protein, 125 aa, Arachis hypogaea
MAGRLANAASRIMAGNGVVSRSVGSSLRLRSGMGLPVGKHIVPDKPLPANDELVWDNGTPFPEPCIDRIADTVGKYEALAWLCGGLSFFASLGLLAVWNDKASKIPYTPKVYPYDNLRVELGGEP

SEQ ID NO: 7097 - protein, 125 aa, Cajanus cajan
MAGRLTNAASRILGGNGVVCRSVASSLRLRSGMGLPVGKHCVPDKPLPMNDELVWDNGTPFPEPCIDRIADTVGKYEALAWLCGGLSFFASLGLLAVWNDKASKIPFAPKVYPYDNLRVELGGEP

SEQ ID NO: 7098 - protein, 125 aa, Glycine max
MAGRLTNAASRILGGNGVVYRSVASSLRLRSGMGLPVGKHYVPDKPLPMNEELLWDNGTAFPEPCIDRIADTVGKYEALAWLCGGLSFFASLGLLAVWNDKASKTPFAPKVYPYDNLRVELGGEP

SEQ ID NO: 7099 - protein, 125 aa, Fragaria vesca
MAGRLSSAASKIMGGNGVVHRSVASSLRLRAGMGLPVGKHIVPDRPLPVNDELTWDNGTPFPEPCIDRIADTVGKYEALAWLTGGLSCFVGLGLLAVWNDKASKIPFAPKVYPYDNLRVELGGEP

SEQ ID NO: 7100 - protein, 109 aa, Brassica juncea
GVVARTNASSLRQRAGMGLPVGKHIVPDKPLSVNDELMWDNGTAFPEPCIDRIADTVGKYEALGWLCGGLSFFGALGMLAVLNDKASKVPFTPRVYPYDNLRVELGGEP

SEQ ID NO: 7101 - protein, 125 aa, Rosa hybrid cultivar
MAGRLSSAASKIMGGNGVVHRSVASSLRLHAGMGLPVGKHIVPDRPLPVNDELVWDNGTPFPEPCIDRIADTVGKYEALAWLTGGLSCFVGLGLLAVWNDKASKIPFAPKVYPYDNLRVELGGEP

SEQ ID NO: 7102 - protein, 120 aa, Ocimum basilicum
  misc_feature (40)..(40): Xaa can be any naturally occurring amino acid
  misc_feature (42)..(42): Xaa can be any naturally occurring amino acid
HEVASKIMGGNGVVSRSVASSIRQRAGMGLPVGKHIVPNXPXPVNDELVWDNGTAFPEPCIDRIADTVGKYEALAWLCGGLGFFASLGLLAVWNDKASKIPFTPKVYPYDNLRVELGGEP

SEQ ID NO: 7103 - protein, 125 aa, Phaseolus coccineus
MAGRLTNTASRILGGNGVVYRSVASSLRLRSGMGLPVGKHYVPDKPLPMNEELLWDNGTPFPEPCIDRIADTVGKYEALAWLCGGLSFFASLGLLAVWNDKASKIPFAPKVYPYDNLRVELGGEP

SEQ ID NO: 7104 - protein, 125 aa, Cicer arietinum
MAGRLTNAASRILGGNGVVHRSVASSLRLRSGMGLPVGKHYVPNKPLPMNEELLWDNGTPFPEPCIDRIADTVGKYEALAWLCGGLSFFASLGLLAVWNDKASKYPFTPKVYPYDNLRVELGGEP

SEQ ID NO: 7105 - protein, 113 aa, Lactuca sativa
MRGNRVLNRSVISSLRLRSGMGLPVGKHIVPDKPLPVNDELMWDNGTAFPEPCIDRIADTVGKYEALGWLCGGLGFFATLGLMATLNDKASKIPFTPKVFPYYNLRVELGGEP

SEQ ID NO: 7106 - protein, 75 aa, Cajanus cajan
MAGRLTNAASRILGGNGVVCRSVASSLRLRSGMGLPVGKHYVPDKPLPMNDELVWDNGTPFPEPCIDRIADTVGI

SEQ ID NO: 7107 - protein, 125 aa, Tamarix hispida
  misc_feature (101)..(101): Xaa can be any naturally occurring amino acid
  misc_feature (107)..(107): Xaa can be any naturally occurring amino acid
MAGRLSNVASRIMGGHGVVGRSVASSLRQRSGMGLPVGKHIVPDKPLPTNDELVWDNGTPFPEPCIDRIADTIGKYEALGWWLGGLGFFATLGLVTVWYDXPSKIPXTPKVYPYDNLRVELGGEP

SEQ ID NO: 7108 - protein, 126 aa, Brassica oleracea
  misc_feature (46)..(46): Xaa can be any naturally occurring amino acid
MAGRLSGVASRIMGGNGVVARSGASSLRQRAGMGLPVGKHIVPDKXLSVNDELMWDNGTAFPEPCIDRIADTVGKYEALGWLCGGLGFFATLGLLAVVNDKASKVPFVSDLYFNHCCIHHPFLLFD

SEQ ID NO: 7109 - protein, 125 aa, Tropaeolum majus
MAGRLSSVASQIMGGSGVVGRSAASSLRLRGGMGMPVGRHIVPNRPLDVNDELTWDNGTSLPEPCIDRIAPTVGKYEALAWLCGGLSCFAGLGLLAVWNDKASKYPFTPKVYPYDNLRVELGGKP

SEQ ID NO: 7110 - protein, 127 aa, Persea americana
MASAGRMSGVASRIMGGNSLLARSVASSLRNRSGMGLPVGKHIIPDKPLPVNDELVWDNGTPFPEPCLDRIAPTVGKYEALAWWLGGLGFFASVGLMAVWNDKASTVPFTPKVYPYDNLRVELGGEP

SEQ ID NO: 7111 - protein, 150 aa, Persea americana
QLNFLSPATEKTQSDSGHSGVAAMASAGRMSGVASRIMGGNSLLARSVASSLRNRSGMGLPVGKHIIPDKPLPVNDELVWDNGTPFPEPCLDRIAPTVGKYEALAWWLGGLGFFASVGLMAVWNDKASTVPFTPKVYPYDNLRVELGGEP

SEQ ID NO: 7112 - protein, 125 aa, Medicago truncatula
MAGRLTNVASQILGGNGVVHRSVASSLRLRSGMGLPVGKHYVPNKPLPMNEELTWDNGTPFPEPCIDRIADTVGKYEALAWLCGGLSCFAGLGLLAVWNDKASKTPFAPKVYPYDNLRVELGGEP

SEQ ID NO: 7113 - protein, 117 aa, Quercus alba
MAGRLSNVASRIMGGNGVVCRSVASSLRLRAGMGLPVGKHIVPDKPLPVNDELVWDNGTPFPEPCIDRIADTVGKYEALAWLCGGLSCFAGLGLLAVWNDKASKIPFAPKVYPYDNL

SEQ ID NO: 7114 - protein, 127 aa, Unknown
  Sequence found in Organisms: Cucumis sativus, Cucumis melo
MAGKLTNLGSKILGGNGVVGRSIASSLRLRSGMGLPVGKHIVPDKPLPENDELVWDNGTPFPEPCIDRIADTVGKYEALAWLCGGLGFFASLGFLAVWNDKASKIPFAPKVYPYDNLRVELGGDPEA

SEQ ID NO: 7115 - protein, 125 aa, Orobanche aegyptiaca
MAGRLTHAASRIMGRSDGVSRSVGSSLRRRSGMGLPAGRHIVPDKPLQVNDELVWDNGTPFPEPCIDRIADTVGKYEALAWLCGGLGFFASLGLLAVWNDKASKIPFTPKVYPYDNLRLELGEEP

SEQ ID NO: 7116 - protein, 125 aa, Gerbera hybrid cultivar
MAGRLSHAVSQIMGGNGVVGRSVAASLRLRSEMGLPDGKHIVPDKPLPVNDELVWNNGTPFPEPCIDRIADTVGKYETLGWLCGGLGFFATLGLMAVWNDKASTIPYTPKVFPYDNLRVELGGEL

SEQ ID NO: 7117 - protein, 389 aa, Arabidopsis lyrata
MANGANRVDLDGKPIKPITICMIGAGGFIGSHLCEKLMTETPHKVLALDVYNDKIKHLLEPDTVEWSGRIQFHRINIKHDSRLEGLIKMADLTINLAAICTPADYNTRPLDTIYSNFIDALPVVKYCSENNKRLIHFSTCEVYGKTIGSFLPKDHPLREDPAFYVLKEDISPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTEVYAKVSGEGAIESPTVDVSSKEFYGEGYDDSDKRIPDMTIINRQLGWNPKTSLWDLLESTLTYQHKTYAEAVKKATSKPVAS

SEQ ID NO: 7118 - protein, 389 aa, Arabidopsis lyrata
MANGAGRLDLDGKPIKPITICMIGAGGFIGSHLCEKLMTETPHKVLALDVYNDKIKHLLEPDTVQWAGRIQFHRINIKHDSRLEGLIKMADLTINLAAICTPADYNTRPLDTIYSNFIDALPVVKYCSENNKRLIHFSTCEVYGKTIGSFLPKDHPLRQDPEFYVLKEDISPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTEVYAKVSGETAIESPTIDVSSKEFYGEGYDDSDKRIPDMTIINRQLGWNPKTSLWDLLESTLTYQHTTYAEAIKKATSKPVAS

SEQ ID NO: 7119 - protein, 386 aa, Theobroma cacao
MATRMDLDGKPIKPITICMIGAGGFIGSHLCEKLMAETPHKVLALDVYNDKIKHLLEPDSLPWADRIQFHRLNIKHDSRLEGLIKMADLTINLAAICTPADYNTRPLDTIYSNFIDALPVVKYCSENNKRLIHFSTCEVYGKTIGSFLPKDSPLRQDPAYYVLKEDESPCIFGSIEKQRWSYACAKQLIERLIYAEGAENGLEFTIVRPFNWIGPRMDFIPGIDGPSEGVPRVLACFSNNLLRREPLKLVDGGQSQRTFVYIKDAIEAVLLMIENPDRANGHIFNVGNPNNEVTVRQLAEMMTEVYTKVSGEPSLEVPTIDISSKEFYGEGYDDSDKRIPDMTIINRQLGWNPKTSLWDLLESTLTYQHRTYAEAIKKSMAKPTAS

SEQ ID NO: 7120 - protein, 387 aa, Glycine max
MASSRVDLDGNPIKPITICMIGAGGFIGSHLCEKLMSETPHSVLALDVYNDKIKHLLEPHTLPWASRIQFHRLNIKHDSRLEGLIKMSDLTINLAAICTPADYNTRPLDTIYSNFIDALPVVKYCSENNKRLIHFSTCEVYGKTIGSFLPKDSPLRQDPAYYVLKEDESPCIFGSIEKQRWSYACAKQLIERLVYAEGAENGLEFTIVRPFNWIGPRMDFIPGIDGPSEGVPRVLACFSNNLLRGEPLKLVDGGQSQRTFVYIKDAIEAVLLMIENPARANGHIFNVGNPNNEVTVRQLAEMMTQVYSKVSGEAPLEKPTIDVSSKEFYGEGYDDSDKRIPDMTIINRQLGWNPKTSLWDLLESTLTYQHRTYAEAVKKVIAKPVAS

SEQ ID NO: 7121 - protein, 387 aa, Gossypium hirsutum
MAASRMDLDGRPIKPITICMIGAGGFIGSHLCEKLMSETPHKVLALDVYNDKIKHLLEPDSLPWAGRIQFHRLNIKHDSRLEGLIKMADLTINLAAICTPADYNTRPLDTIYSNFIDALPVVKYCSENNKRLIHFSTCEVYGKTIQSFLPKDSPLRQDPAYYVLKEDVSPCIFGSIEKQRWSYACAKQLIERLIYAEGAENGLEFTIVRPFNWIGPRMDFIPGIDGPSEGVPRVLACFSNNLLRREPLKLVDGGQSQRTFVYIKDAIEAVLLMIENPGRANGHIFNVGNPNNEVTVRQLAEMMTKVYTKVSGESALETPTIDVSSKEFYGEGYDDSDKRIPDMTIINKQLGWNPKTSLWDLLESTLTYQHRTYAEAIKKSMAKPTSS

SEQ ID NO: 7122 - protein, 387 aa, Phaseolus coccineus
MASARLDLDGNPIKPITICMIGAGGFIGSHLCEKLMSETPHKVFALDVYNDKIKHLLEPDTLPWAGRIQFHRLNIKHDSRLEGLIKTADLTINLAAICTPADYNTRPLDTIYSNFIDALPVVKYCSENNKRLIHFSTCEVYGKTIGSFLPKDSALRQDPAYYVLKEDESPCIFGSIEKQRWSYACAKQLIERLVYAEGAENGLEFTIVRPFNWIGPRMDFIPGIDGPSEGVPRVLACFSNNLLRGEPLKLVDGGQSQRTFVYIKDAIEAVLLMIENPGRANGHIFNVGNPNNEVTVRQLAEMMTQVYSKVSGESPLEKPTIDVSSKEFYGEGYDDSDKRIPDMTIINRQLGWNPETSLWDLLESTLTYQHRTYAEAIKKVIAKPVAS

SEQ ID NO: 7123 - protein, 387 aa, Vigna unguiculata
MASARLDLDGNPIKPITICMIGAGGFIGSHLCEKLMNETPHKVFALDVYNDKIKHLLEPDTLPWAGRIQFHRLNIKHDSRLEGLIKIADLTINLAAICTPADYNTRPLDTIYSNFIDALPVAKYCSENNKRLIHFSTCEVYGKTIGSFLPKDSALRQDPAYYVLKEDESPCIFGSIEKQRWSYACAKQLIERLIYAEGAENGLEFTIVRPFNWIGPRMDFIPGIDGPSEGVPRVLACFSNNLLRGEPLKLVDGGQSQRTFVYIKDAIEAVLLMIENPARANGHIFNVGNPNNEVTVRQLAEMMSQVYSKVSGEAPLEKPTVDVSSKEFYGEGYDDSDKRIPDMTIINRQLGWNPKTSLWDLLESTLTYQHRTYAEAIKKVIAKPVAS

SEQ ID NO: 7124 - protein, 387 aa, Lotus japonicus
MASSRVDLDGNPIAPLTICMIGAGGFIGSHLCEKLMSETPHKVLALDVYSDKIKHLLEPDNLPWHGRIHFHRLNIKHDSRLEGLIKMADLTINLAAICTPADYNTRPLDTIYSNFIDALPVVKYCSENNKRLIHFSTCEVYGKTIGSFLPKDSPLRQDPAYYVLKEDESPCIFGSIEKQRWSYACAKQLIERLIYAEGAENNMEFTIVRPFNWIGPRMDFIPGIDGPSEGVPRVLACFSNNLLRGEPLKLVDGGESQRTFVYIKDAIEAVLLMIENPGRANGHIFNVGNPHNEVTVRQLAEMMIQVYSKVSGEQAPETPTLDVSSKEFYGEGYDDSDKRIPDMTIINRQLGWNPKTSLWDLLESTLTYQHRTYAEAVKKAIAKPIAS

SEQ ID NO: 7125 - protein, 387 aa, Arachis hypogaea
MASSRVDLDGNPIKPITICMIGAGGFIGSHLCEKLMTETPHTVLALDVYNDKIKHLLEPETNPWHGRINFHRLNIKHDSRLEGLIKMADLTINLAAICTPADYNTRPLDTIYSNFIDALPVVKYCSENNKRLIHFSTCEVYGKTIGSFLPKDSPLRKDPAYYVLKEDESPCIFGSIEKQRWSYACAKQLIERLIYAEGAENGLEFTIVRPFNWIGPRMDFIPGIDGPSEGVPRVLACFSNNLLRKEPLKLVDGGQSQRTFVYIKDAIEAVLLMIENPARANGHIFNVGNPNNEVTVRQLGEMMVKVYSKVSGDPPLENATVDVSSKEFYGEGYDDSDKRIPDMTIINRQLGWNPKTSLWDLLESTLTYQHRTYAEAIKKVIAKPVAS

SEQ ID NO: 7126 - protein, 386 aa, Ipomoea nil
MAGRVDLDGNPIKPITICMIGAGGFIGSHLCEKLMSETQHTVLAVDVYNDKIKHLLEPASLPWADRIQFHRLNIKNDSRLEGLIKMADLTVNLAAICTPADYNTRPLDTIYSNFIDALPVVKYCSENGKRLIHFSTCEVYGKTIGCFLPKDSPLRQDPAYYVLKEDVSPCIFGPIEKQRWSYACAKQLIERLVYAEGAENGLEFTIVRPFNWIGPRMDFIPGIDGPSEGVPRVLACFSNNLLRREPLKLVDGGQSQRTFVYIKDAIEAVVLMIENPARANGHIFNVGNPNNEVTVRQLAEMMTQVYSKVSGEVSLETPTIDVSSKEFYGEGYDDSDKRIPDMTIINRQLGWNPKTSLWDLLESTLTYQHRTYAEAIKKAVSKPTAS

SEQ ID NO: 7127 - protein, 387 aa, Orobanche aegyptiaca
MASGRLDLDGNPIKPLAICMIGAGGFIGSHLCEKLMAETPHKVMAVDVYNDKIKHLLEPSSLPWADRIQFHRLNIKNDSRLENLIQMSDLTINLAAICTPADYNTRPLDTIYSNFTDALPVVKYCSEKGKRLIHFSTCEVYGKTIGSFLPKDSPLRQDPEYYVLKEDSSPCIFGSIEKQRWSYACAKQLIERLIYAEGAENDLEFTIVRPFNWIGPRMDFIPGIDGPSEGVPRVLACFSNNLLRREPLKLVDGGESQRTFIYIKDAIEAVLLMIENPARANGHIFNVGNPNNEVTVRQLAEMMTEVYSKVSGESALETPTVDISSKDFYGEGYDDSDKRIPDMTIINKQLGWNPKTSLWDLLESTLTYQHRTYAEAVKKATSKPTAS

SEQ ID NO: 7128 - protein, 389 aa, Malus domestica
MASSARVDLDGNPIKPITICMIGAGGFIGSHLCEKLMSETPHKVLALDVYNDKIKHLLEPENAHPWSDRIQFHRLNIKQDSRLEGLIKMADLTINLAAICTPADYNTRPLDTIYSNFIDALPVVKYCSENNKRLIHFSTCEVYGKTIGSYLPKDSPLRQDPAYYVLKEDESPCIFGSIEKQRWSYACAKQLIERLIYAEGAENGLEFTIVRPFNWIGPRMDFIPGIDGPSEGVPRVLACFSNNLLRREPLKLVDGGQSQRTFVYIKDAIEAVMLMIENPARANGHIFNVGNPNNEVTVRQLGEMMTEVYVKVSGEPKLETPTIDVSSQEFYGVGYDDSDKRIPDMTIINKQLGWNPKTSLWDLLESTLTYQHRTYAEAVKKAISQSSAS

SEQ ID NO: 7129 - protein, 386 aa, Ipomoea nil
MAGRVDLDGNPIKPITICMIGAGGFIGSHLCEKLMSETQHKVLAVDVYNDKIKHLLEPASLPWADRIQFHRLNIKNDSRLEGLIKMADLTVNLAAICTPADYNTRPLDTIYSNFIDALPVVKYCSENGKRLIHFSTCEVYGKTIGCFLPKDSPLRQDPAYYVLKEDASPCIFGPIEKQRWSYACAKQLIERLVYAEGAENGLEFTIVRPFNWIGPRMDFIPGIDGPSEGVPRVLACFSNNLLRREPLKLVDGGQSQRTFVYIKDAIEAVVLMIENPARANGHIFNVGNPNNEVTVRQLAEMMTQVYSKVSGEVSLETPTIDVSSKEFYGEGYDDSDKRIPDMTIINRQLGWNPKTSLWDLLESTLTYQHRTYAEAIKKAVSKPTAS

SEQ ID NO: 7130 - protein, 386 aa, Capsicum annuum
MAGKVDLDGNAIKPITICMIGAGGFIGSHLCEKLMHETSHKVLAVDVYSDKIKHLLEPATLDWADRIQFHRINIKNDSRLEGLIKMADLTINLAAICTPADYNTRPLDTIYSNFIDALPVVKYCSENGKRLIHFSTCEVYGKTIGAFLPKDSPLRKDPAYYVLKEDTSPCIFGSIEKQRWSYACAKQLIERLIYAEGAENGLEFTIVRPFNWIGPRMDFIPGIDGPSEGVPRVLACFSNNLLRREPLKLVDGGESQRTFIYIKDAIEAVLLMIENPARANGHIFNVGNPNNEVTVRQLAEMMTQVYSKVSGESSIETPTIDVSSKEFYGEGYDDSDKRIPDMTIINKQLGWNPKTSLWDLLESTLTYQHRTYAEAIKQAMSKTTAN

SEQ ID NO: 7131 - protein, 386 aa, Nicotiana tabacum
MAGRVDLDGNPINPITICMIGAGGFIGSHLCEKLMSETPHKVLAVDVYNDKIKHLLEPATLTWADRIQFHRINIKNDSRLEGLIKMADLTINLAAICTPADYNTRPLDTIYSNFIDALPVVKYCSENGKRLIHFSTCEVYGKTIGAFLPKDSPLRQDPAYYVLKEDASPCIFGSIEKQRWSYACAKQLIERLIYAEGAENGLEFTIVRPFNWIGPRMDFIPGIDGPSEGVPRVLACFSNNLLRREPLKLVDGGESQRTFIYIKDAIEAVLLMIENPARANGHIFNVGNPNNEVTVRQLAEMMTQVYSKVSGESSLETPTIDVSSKEFYGEGYDDGDKKIPDMTIINKQLGWNPKTSLWDLLESTLTYQHRTYAEAIKQAMSKTTAN

SEQ ID NO: 7132 - protein, 389 aa, Malus domestica
MASSARVDLDGNPIKPITICMIGAGGFIGSHLCEKLMSETPHKVLALDVYNDKIKHLLEPENAHPWSDRIQFHRLNIKQDSRLEGLIKMADLTINLAAICTPADYNTRPLDTIYSNFIDALPVVKYCSENNKRLIHFSTCEVYGKTIGSYLPKDSPLRQDPAYYVLKEDESPCIFGSIEKQRWSYACAKQLIERLIYAEGAENGLEFTIVRPFNWIGPRMDFIPGIDGPSEGVPRVLACFSNNLLRREPLKLVDGGQSQRTFVYIKDAIEAVMLMIENPARANGHIFNVGNPNNEVTVRQLGEMMTEVYAKVSSEPKLETPTIDVSSQEFYGVGYDDSDKRIPDMTIINKQLDWNPKTSLWDLLESTLTYQHRTYAEAVKKAISQSSAS

SEQ ID NO: 7133 - protein, 386 aa, Solanum tuberosum
MAGRVDLDGNPIKPITICMIGAGGFIGSHLCEKLMSETPHKVLAVDVSNDKIKHLLEPATLAWADRIEFHRINIKNDSRLEGLIKMADLTINLAAICTPADYNTRPLDTIYSNFIDALPVVKYCSENGKRLIHFSTCEIYGKTIGAFLPKDSPLRQDPAYYVLKEDTSPCIFGPIEKQRWSYACAKQLIERLIYAEGAENGLEFTIVRPFNWIGPRMDFIPGIDGPSEGVPRVLACFSNNLLRREPLKLVDGGESQRTFIYIKDAIDAVLLMIENPARANGHIFNVGNPNNEVTVRQLAEMMTKVYSKVSGESSLETPTIDVSSKEFYGEGYDDSDKRIPDMTIINKQLAWNPKTSLWDLLESTLTYQHRTYAEAIKQAMSKSTAN

SEQ ID NO: 7134 - protein, 386 aa, Solanum phureja
MAGRVDLDGNPIKPITICMIGAGGFIGSHLCEKLMSETPHKVLAVDVSNDKIKHLLEPATLAWADRIEFHRINIKNDSRLEGLIKMADLTINLAAICTPADYNTRPLDTIYSNFIDALPVVKYCSENGKRLIHFSTCEIYGKTIGAFLPKDSPLRQDPAYYVLKEDTSPCIFGPIEKQRWSYACAKQLIERLIYAEGAENGLEFTIVRPFNWIGPRMDFIPGIDGPSEGVPRVLACFSNNLLRREPLKLVDGGESQRTFIYIKDAIEAVLLMIENPARANGHNFNVGNPNNEVTVRQLAEMMTKVYSKVSGESSLETPTIDVSSKEFYGEGYDDSDKRIPDMTIINKQLAWNPKTSLWDLLESTLTYQHRTYAEAIKQAMSKSTAN

SEQ ID NO: 7135 - protein, 386 aa, Solanum lycopersicum
MAGRVDLDGNPIKPITICMIGAGGFIGSHLCEKLMSETPHKVLAVDVSNDKIKHLLEPATLAWADRIEFHRINIKNDSRLEGLIKMADLTINLAAICTPADYNTRPLDTIYSNFIDALPVVKYCSENGKRLIHFSTCEIYGKTIGAFLPKDSPLRQDPAYYVLKEDTSPCIFGPIEKQRWSYACAKQLIERLIYAEGAENGLEFTIVRPFNWIGPRMDFIPGIDGPSEGVPRVLACFSNNLLRREPLKLVDGGESQRTFIYIKDAIEAVLLMIENPARANGHIFNVGNPNNEVTVRQLAEMMTKVYSKVSGESSLETPTIDISSKEFYGEGYDDSDKRIPDMTIINKQLAWNPKTSLWDLLESTLTYQHRTYAEAIKQAMSKSTAN

SEQ ID NO: 7136 - protein, 387 aa, Triphysaria pusilla
MASGRVDLDGKSIKPITICMIGAGGFIGSHLCEKLMSETPHTVLAVDVYNDKIKHLLEPSSLPWNGRIQFHRINIKNDSRLEGLIRMADLTVNLAAICTPADYNTRPLDTIYSNFIDALPVVKYCSENGKRLIHFSTCEVYGKTIGSYLPKDSPLRQDPAYYILKEDTSPCIFGSIEKQRWSYACAKQLIERLIYAEGAENGMEFTIVRPFNWIGPRMDFIPGIDGPSEGVPRVLACFSNNLLRREPLKLVDGGESQRTFVYIKDAIEAVLLMIENPARANGHIFNVGNPNNEVTVRQLAEMMTQVYSKVSGESPVETPTIDISSKEFYGEGYDDSDKRIPDMTIINRQLGWNPKTSLWDLLESTLTYQHKTYAEAVKKATSQTMAS

SEQ ID NO: 7137 - protein, 390 aa, Prunus persica
MASVARVDLDGNPIKPITICMIGAGGFIGSHLCEKLMSETPHKVLALDVYNDKIKHLLEPENAHPWSDRIQFHRLNIKQDSRLEGLIKMADLTINLAAICTPADYNTRPLDTIYSNFIDALPVVKYCSENNKRLIHFSTCEVYGKTIGSYLPKDSPLRQDPAYYVLKEDESPCIFGSIEKQRWSYACAKQLIERLIYAEGAENGLEFTIVRPFNWIGPRMDFIPGIDGPSEGVPRVLACFSNNLLRREPLKLVDGGQSQRTFVYIKDAIEAVMLMIENPARANGHIFNVGNPNNEVTVRQLGEMMTEVYVKVSGESKLETPTIDVSSQEFYGVGYDDSDKRIPDMTIINKQLGWNPKTSLWDLLESTLTYQHRTYAEAVKKAISQASATS

SEQ ID NO: 7138 - protein, 389 aa, Tropaeolum majus
MATESVRLDLDGKPIKPITICMIGAGGFIGSHLCEKLMTETPHKVLALDVYNDKIKHLLEPDSLPWAGRIQFHRLNIKHDSRLEGLIKMSDLTVNLAAICTPADYNTRPLDTIYSNFIDALPVVKYCSENKKRLIHFSTCEVYGKTVQSFLPKDHPLREDPANYVLKEDSSPCIFGSIEKQRWSYACAKQLVERLIYAEGAENDLEFTIVRPFNWIGPRMDFIPGIDGPSEGVPRVLACFSNNLLRHEPLKLVDGGQSQRTFVYIKDAIEAVHLMIENPGRANGHIFNVGNPNNEVTVRQLAEMMTEVYAKVSGEVPLDSPTIDVSSKEFYGEGYDDSDKRIPDMTIINRQLGWNPKTSLYDLLESTLTYQHRTYAEAIKQTMSKPTTS

SEQ ID NO: 7139 - protein, 387 aa, Orobanche aegyptiaca
MSSGRVDLDGNPIKPITICMIGAGGFIGSHLCEKLMVETPHKVLAVDVYNDKIKHLLEPSSLPWANRIQFHRINIKNDSRLEGLIRMADLTINLAAICTPADYNTRPLDTIYSNFIDALPVVKYCSENAKRLIHFSTCEVYGKTVGCFLPKDSPLRQDPAYYVLSEEASPCIFGPIEKQRWSYACAKQLIERLIYAEGAENGLEFTIVRPFNWIGPRMDFIPGIDGPSEGVPRVLACFSNNLLRREPLKLVDGGESQRTFVYIKDAIEAVLLMIENPARANGHIFNVGNPNNEVTVRQLAEMMTQVYAKVSGESALDTPTIDISSKEFYGDGYDDSDKRIPDMTIINRQLGWNPKTSLWDLLESTLTYQHRTYAEAIKKATSQPLAS

SEQ ID NO: 7140 - protein, 387 aa, Aquilegia formosa
MASRVDLDGNSIKTLTICMIGAGGFIGSHLCEKLLEETLHKILAVDVYNDKIKHLLENSNQLWADRIQFHRINIKHDSRLEGLIKMADLTINLAAICTPADYNTRPLDTIYSNFIDALPVVKYCSENNKRLIHFSTCEVYGKTIGSFLPKDHPLRQDPEFYVLNEETSPCIFGSIEKQRWSYACAKQLIERLIYAEGAENGLEFTIVRPFNWIGPRMDFIPGVDGPSEGVPRVLACFSNNLLRGEPLKLVDGGQSQRTFVYIKDAIEAVHLMIENPARANGHIFNVGNPNNEVTVKQLAEMMSEVYAKVSGETALEVPTVDVSSKEFYGEGYDDSDKRIPDMTIINRQLGWNPKTSLWDLLESTLTYQHRTYAEAVKKAIAKPVATS

SEQ ID NO: 7141 - protein, 390 aa, Prunus persica
  misc_feature (6)..(6): Xaa can be any naturally occurring amino acid
MASVAXVDLDGNPIKPITICMIGAGGFIGSHLCEKLMSETPHKVLALDVYNDKIKHLLEPENAHPWSDRIQFHRLNIKQDSRLEGLIKMADLTINLAAICTPADYNTRPLDTIYSNFIDALPVVKYCSENNKRLIHFSTCEVYGKTIGSYLPKDSPLRQDPAYYVLKEDESPCIFGSIEKQRWSYACAKQLIERLIYAEGAENGLEFTIVRPFNWIGPRMDFIPGIDGPSEGVPRVLACFSNNLLRREPLKLVDGGQSQRTFVYIKDAIEAVMLMIENPARANGHIFNVGNPNNEVTVRQLGEMMTEVYVKVSGESKLETPTIDVSSQEFYGVGYDDSDKRIPDMTIINKQLGWNPKTSLWDLLESTLTYQHRTYAEAVKKAISQASATS

SEQ ID NO: 7142 - protein, 385 aa, Glycine max
MARVDLDGNPMKALTICMIGAGGFIGSHLCEKLMSETPHTVLALDVYNDKIKHLLEPSDSPWAGRITFHRLNIKHDSRLEGLIKMADLTINLAAICTPADYNTRPLDTIYSNFIDALPVVKYCSENNKRLIHFSTCEVYGKTIGAFLPKDSPLRKDPAYYVLKEDESPCIFGSIEKQRWSYACAKQLIERLIYAEGAENGLEFTIVRPFNWIGPRMDFIPGIDGPSEGVPRVLACFSNNLLRGEPLKLVDGGQSQRTFVYIKDAIEAVLLMIENPARANGHIFNVGNPNNEVTVRQLAEIMIKVYSKVSGEQTPETPTVDVSSKEFYGEGYDDSDKRIPDMTIINRQLGWNPKTSLWDLLESTLTYQHRTYAEAVKKVIAKPVAS

SEQ ID NO: 7143 - protein, 389 aa, Cucumis melo
MASSNRVDLGGNPIKPITICMIGAGGFIGSHLCEKLMAETPHKVLALDVYNDKIKHLLEPDTLPWADRIQFHRLNIKNDSRLESLIRMADLTINLAAICTPADYNTRPLDTIYSNFIDAIPVVKYCSGNNKRLIHFSTCEVYGKTIGSFLPKDSPLRQDPSYYVLSEDTSPCIFGPIEKQRWSYACAKQLIERLIYAEGAENGLDFTIVRPFNWIGPRMDFIPGIDGPSEGVPRVLACFSNNLLRREPLKLVDGGQSQRTFVYIKDAIEAVLLMIENPSRSNGQIFNVGNPNNEVTVKQLAEMMTEVYAKVSGEPSLETPTIDISSEEFYGVGYDDSDKRIPDMTIINRQLGWNPKTSLWDLLESTLTYQHRTYAEAIKQATAKPAASS

SEQ ID NO: 7144 - protein, 388 aa, Capsicum annuum
MAGGGRVDLDGNPIKPITICMIGAGGFIGSHLCEKLMAETPHTVLAVDVYCDKIKHLLEPSELPWNGRIQFHRMNIKNDSRLEGLIKMADLTVNLAAICTPADYNTRPLDTIYSNFIDALPVVKYCSENGKRLIHFSTCEVYGKTIGAFLPQDSPLRQDPAFYVLSEDSSPCIFGSIEKQRWSYACAKQLIERLIYAEGAENGLEFSIVRPFNWIGPRMDFIPGIDGPSEGVPRVLACFSNNLLRREPLKLVDGGHSQRTFIYIKDAIEAVLLMIENPARANGFIFNVGNPNNEVTVKQLAEMMTQVYSNVTGLSPLETPTVDVSSKEFYGEGYDDSDKRIPDMTIINRQLGWNPKTSLWDLLESTLTYQHRTYAEAVKQAMSKSTAN

SEQ ID NO: 7145 - protein, 385 aa, Helianthus annuus
MARVDLDGNVIKPMTICMIGAGGFIGSHLCEKLMSETPHTVLAVDVYNDKIKHLLEPDSLPWNGRIQFHRLNIKNDSRLEGLIKCSDLTINLAAICTPADYNTRPLDTIYSNFIDALPVVKYCSENNKRLIHFSTCEVYGKTIGSFLPKDSPLRQDPAYYILKEDTSPCIFGSVEKQRWSYACAKQLIERLIYAEGAENGLEFTIVRPFNWIGPRMDFIPGIDGPSEGVPRVLACFSNNLLRREPLKLVDGGESQRTFIYIKDAIEAVLLMIENPARASGHIFNVGNPNNEVTVRQLAEMMTQVYSKVSGEDAIETPTIDVSSKEFYGEGYDDSDKRIPDMTIINKQLGWNPKTSLWDLLESTLTYQHRTYAEAIKQAIAKPSAN

SEQ ID NO: 7146 - protein, 389 aa, Cucumis sativus
MASGNRVDLSGNPVKPITICMIGAGGFIGSHLCEKLMAETPHKVLALDVYNDKIKHLLEPDTLPWADRIQFHRLNIKNDSRLESLIRMADLTINLAAICTPADYNTRPLDTIYSNFIDAIPVVKYCSGNSKRLIHFSTCEVYGKTIGSFLPKDSPLRQDPSYYVLSEDTSPCIFGSIEKQRWSYACAKQLIERLIYAEGAENGLDFTIVRPFNWIGPRMDFIPGIDGPSEGVPRVLACFSNNLLRREPLKLVDGGQSQRTFVYIKDAIEAVLLMIENPSRSNGQIFNVGNPNNEVTVKQLAEMMTEVYAKVSGEPSLQTPTIDISSEEFYGVGYDDSDKRIPDMTIINRQLGWNPKTSLWDLLESTLTYQHRTYAEAIKQATAKPAASS

SEQ ID NO: 7147 - protein, 389 aa, Helianthus annuus
MTSSPPRLDLDGNPINPLTICMIGAGGFIGSHLCEKLMSETNHTVLAVDVYSDKIKHLLEPDSVPWSGRIQFHRINIKNDSRLEGLIKCSDLTVNLAAICTPADYNTRPLDTIYSNFIDALPVVKYCSENNKRLIHFSTCEVYGKTIGSFLPPDSPLRQDPAYYILKEDTSPCIFGSIEKQRWSYACAKQLIERLIYAEGAENGLEFTIVRPFNWIGPRMDFIPGIDGPSEGVPRVLACFSNNLLRREPLKLVDGGESQRTFVYIKDAIEAVHLMIENPARANGHIFNVGNPNNEVTVRQLAEMMTKVYAKVSGEDSIETPTIDVSSKEFYGEGYDDSDKRIPDMTIINKQLGWNPKTSLWDLLESTLTYQHRTYAEAVRQSIAKPVAS

SEQ ID NO: 7148 - protein, 385 aa, Phaseolus coccineus
MARVDLDGNPIKPLTICMIGAGGFIGSHLCEKLMSETPHTVFALDVYNDKIKHLLEPDSLPWAGRITFHRLNIKHDSRLEGLIKMADLTINLAAICTPADYNTRPLDTIYSNFIDALPVVKYCSENNKRLIHFSTCEVYGKTIGAFLPKDSPLRKDPAYYILKEDESPCIFGSIEKQRWSYACAKQLIERLIYAEGAENGLEFTIVRPFNWIGPRMDFIPGIDGPSEGVPRVLACFSNNLLRGEPLKLVDGGQSQRTFVYIKDAIEAVLLMIENPARANGHIFNVGNPNNEVTVRQLAEIMIQVYSKVSGEKSPETPTIDVSSKEFYGEGYDDSDKRIPDMTIINRQLGWNPETSLWDLLESTLTYQHRTYAEAIKKVIAKPVAS

SEQ ID NO: 7149 - protein, 389 aa, Artemisia annua
MTSPSARVDLDGNAIKPLTICMIGAGGFIGSHLCEKLMNETDHTVLAVDVYNDKIKHLLEPDSLPWNGRIQFHRLNIKNDSRLEGLIKCSDLTVNLAAICTPADYNTRPLDTIYSNFIDALPVVKYCSENNKRLIHFSTCEVYGKTIGSYLPKDSPLRQDPAYYILKEDTSPCIFGSIEKQRWSYACAKQLIERLIYAEGAENGLEFTIVRPFNWIGPRMDFIPGIDGPSEGVPRVLACFSNNLLRREPLKLVDGGESQRTFVYIKDAIEAVHLMIENPARANGHIFNVGNPNNEVTVRQLAEMMTKVYAKVSGEDSIETPTIDVSSKEFYGEGYDDSDKRIPDMTIINKQLGWDPKTSLWDLLESTLTYQHRTYAEAVKQSISKPIAN

SEQ ID NO: 7150 - protein, 387 aa, Glycine max
MARVDLDGNPIKPLTICMIGAGGFIGSHLCEKLMSETPHTVLALDVYSDKIKHLLDPADSPLPWAGRITFHRLNIKHDSRLEGLIKMADLTINLAAICTPADYNTRPLDTIYSNFIDALPVVKYCSENNKRLIHFSTCEVYGKTIGAFLPKDSPLRKDPAYYVLKEDESPCIFGSIEKQRWSYACAKQLIERLIFAEGAENGLEFTIVRPFNWIGPRMDFIPGIDGPSEGVPRVLACFSNNLLRGEPLKLVDGGQSQRTFIYIKDAIEAVLLMIENPARANGHIFNVGNPNNEVTVRQLAEIMIQVYSKVSGEQTAETPTIDVSSKEFYGEGYDDSDKRIPDMTIINKQLGWNPKTSLWDLLESTLTYQHRTYAEAVKKVIAKPLAS

SEQ ID NO: 7151 - protein, 260 aa, Nicotiana tabacum
MESVSFTFPLVKFMGKTIGAFLPEDSPLRQDPAYYVLKEDASPCIFESIEKQRWSYACAKQLIERLIYAEGAENGLEFTIVRPFNWIGPRMDFIPGIDGPSEGVPRVLACFSNNLLRHEPLKLVDGGHSQRTFIYIKDAIEAVLLMIENPARANGQIFNVGNPNNEVTVRQLAEMMTQVYSKVSGESPLETPTIDVSSKEFYGEGYDDSDKRIPDMTIINRQLGWNPKTSLWDLLESTLTYQHRTYAEAVKQAMSKTTVN

SEQ ID NO: 7152 - protein, 389 aa, Tropaeolum majus
MAKEPVRLDLDGNQINPITICMIGAGGFIGSHLCEKLMLDTPHKVLALDVYNDKIKHLLEPDSLPWAGRIQFHRLNIKHDSRLEGLIKMADLTINLAAICTPADYNTRPLDTIYSNFIDALPVVKYCSENKKRLIHFSTCEVYGKTVQSFLPKDHPLRDDPAYYVLNEQTSPCIFGSIEKQRWSYACAKQLIERLIYAEGAENDLEFTIVRPFNWIGPRMDFIPGIDGPSEGVPRVLACFSNNLLRHEPLKLVDGGQSQRTFVYIKDAIEAVQLMIENPARANSHIFNVGNPHNEVTVRQLAEMMTEVYAKVSGETPLDSPTIDISSKEFYGEGYDDSDKRIPDMTIINRQLGWNPKTSLWDLLESTLTYQHRTYAEAVKQAIAKPTAS

SEQ ID NO: 7153 - protein, 387 aa, Nicotiana benthamiana
  misc_feature (152)..(152): Xaa can be any naturally occurring amino acid
  misc_feature (365)..(365): Xaa can be any naturally occurring amino acid
MAGGRVDLDGNVIKPMKICMIGAGGFIGSHLCEKLMNETPHTVLAVDVYSDKIKHLLEPADLPWTGRIQFHRINIKNDSRLEGLIKMADLVVNLAAICTPADYNTRPLDTIYSNFIDALPVVKYCSENGKRLIHFSTCEVYGKTIGAFLPEXSPLRQDPAYYVLKEDVSPCIFGSIEKQRWSYACAKQLIERLIYAEGAENGLEFTIVRPFNWIGPRMDFIPGIDGPSEGVPRVLACFSNNLLRHEPLKLVDGGHSQRTFIYIKDAIEAVLLMIENPARANGQIFNVGNPNNEVTVRQLAEMMTQVYSKVSGESPPETPTIDVSSKEFYGEGYDDSDKRIPDMTLINRQLGWNPKTSLWDLLESXLTYQHRTYAEAVKQAMSKTTAN

SEQ ID NO: 7154 - protein, 389 aa, Artemisia annua
SSPSPVRLDLDGNTIKPLTICMIGAGGFIGSHLCEKLMNETNHTVLAVDVYNDKIKHLLEPESAPWTGRIQFHRLNIKNDSRLEGLIKCSDLTINLAAICTPADYNTRPLDTIYSNFIDALPVVKYCSENNKRLIHFSTCEVYGKTIGSYLPKDSPLRQDPAYYILKEDTSPCIFGSVEKQRWSYACAKQLIERLIYAEGAENGLEFTIVRPFNWIGPRMDFIPGIDGPSEGVPRVLACFSNNLLRREPLKLVDGGESQRTFIYIKDAIEAVLLMIENPARASGHIFNVGNPNNEVTVRQLAEMMTQVYSKVSGEDSIETPTVDVSSKEFYGEGYDDSDKRIPDMTIINKQLGWNPKTSLWDLLESTLTYQHRTYAEAIKQAIAKPAAN

SEQ ID NO: 7155 - protein, 390 aa, Medicago truncatula
MASPSSTRIDLDGNPIKPLTICMIGAGGFIGSHLCEKLMSETSHKVLALDVYNDKIKHLLEPESLPWNGRIHFHRLNIKNDSRLEGLIKMADLVINLAAICTPADYNTRPLDTIYSNFIDALPVVKYCSETNKRLIHFSTCEVYGKTIGSYLPKDSPLRQDPAYYMLKEDVSPCIFGSIEKQRWSYACAKQLIERLVYAEGAENGLEFTIVRPFNWIGPRMDFIPGIDGPSEGVPRVLACFSNNLLRGEPLKLVDGGESQRTFVYIKDAIEAVLLMIENPARANGHIFNVGNPNNEVTVRQLAEMMIQVYSKVSGTQPPETPTIDVSSKEFYGEGYDDSDKRIPDMTIINKQLEWNPKTSLWDLLESTLTYQHRTYAEAIKKVIAQPIAS

SEQ ID NO: 7156 - protein, 382 aa, Petunia hybrida
IDLDGNVIKPITICMIGAGGFIGSHLCEKLMSETAHTVLAVDVYNDKIKHLLEPSTLPWANRIQFHRINIKNDSRLEGLIKMADLTINLAAICTPADYNTRPLDTIYSNFIDALPVVKYCSENGKRLIHFSTCEVYGKTIGAFLPKDSPLRQDPAYYVLKEDASPCIFGPIEKQRWSYACAKQLIERLIYAEGAENGLEFTIVRPFNWMGPRMDFIPGIDGPSEGVPRVLACFSNNLLRREPLKLVDGGESQRTFIYIKDAIEAVILMIENPARANGHIFNVGNPNNEVTVRQLAEMMTQVNSKVSGESSLETPTIDVSSKEFYGEGYDDSDKRIPDMTIINKQLGWNPKTSLWDLLESTLTYQHRTYAEAIKQAMSKATAN

SEQ ID NO: 7157 - protein, 394 aa, Arachis hypogaea
MASSASAGASARVDLDGNPIKPLTICMIGAGGFIGSHLCEKLMSETQHKVLALDVYNDKIKHLLEPDNLPWHGRITFHRLNIKHDSRLEGLIKMSDLTINLAAICTPADYNTRPLDTIYSNFIDALPVVKYCSENNKRLIHFSTCEVYGKTIGSFLPKDSPLRQDPAYYVLKEDESPCIFGSIEKQRWSYACAKQLIERLIYAEGAENGMEFTIVRPFNWIGPRMDFIPGVDGPSEGVPRVLACFSNNLLRGQPLKLVDGGQSQRTFVYIKDAIEAVTLMIENPARANGHIFNVGNPNNEVTVRQLAEMMIKVYSKVSGEQPPETPTIDVSSKEFYGEGYDDSDKRIPDMTTINRQLGWNPKTSLWDLLESTLTYQHRTYAEAIKKVIAKPVAS

SEQ ID NO: 7158 - protein, 390 aa, Trifolium pratense
MASPSSTRLDLDGNPIKPLTICMIGAGGFIGSHLCEKLMSETSHKVLALDVYSDKIKHLLEPESLPWNGRIHFHRLNIKNDSRLEGLIKMADLVINLAAICTPADYNTRPLDTIYSNFIDALPVVKICSDTNKRLIHFSTCEVYGKTIGSFLPKDSPLRQDPAYYVLKEDESPCIFGPIEKQRWSYACAKQLIERLVYAEGAENGLEFTIVRPFNWIGPRMDFIPGIDGPSEGVPRVLACFSNNLLRGEPLKLVDGGESQRTFVYIKDAIEAVLLMIENPARANGHIFNVGNPNNEVTVRQLAEMMTKVYTKVSGDQPPETPTIDVSSKEFYGEGYDDSDKRIPDMTIINKQLGWNPKTSLWDLLESTLTYQHRTYAEAIKKVIAQPITS

SEQ ID NO: 7159 - protein, 392 aa, Vigna unguiculata
SVKRSSTMARVDLDGNPIKPITICMIGAGGFIGSHLCEKLMHETPHTVFALDVYNDKIKHLLEPDSLPWAGRITFHRLNIKHDSRLEGLIKMADLTINLAAICTPADYNTRPLDTIYSNFIDALPVVKYCSENNKRLIHFSTCEVYGKTIGAFLPKDSPLRKDPAYYVLKEDESPCIFGSIEKQRWSYACAKQLIERLIYGEGAENGLEFTIVRPFNWIGPRMDFIPGIDGPSEGVPRVLACFSNNLLRGEPLKLVDGGQSQRTFVYIKDAIEAVLLMIENPARANGHIFNVGNPNNEVTVRQLAEIMIQVYSKVSGEKTPATPTIDVSSKEFYGEGYDDSDKRIPDMTIINKQLGWNPKTSLFDLLESTLTYQHKTYAEAIKKVIAKPVAS

SEQ ID NO: 7160 - protein, 389 aa, Petunia hybrida
MAGGRVDLDGNVIKPMTICMIGAGGFIGSHLCEKLMNETQHTVLAVDVYSDKIKHLLEAPEGSLPWTGRIHFHRINIKNDSRLEGLIKMADLVVNLAAICTPADYNTRPLDTIYSNFIDALPVVKYCSENGKRLIHFSTCEVYGKTVGAFLPEDSPLKQDPAYYVLKEDESPCIFGPIEKQRWSYACAKQLIERLIYAEGAENGLEFTIVRPFNWIGPRMDFIPGIDGPSEGVPRVLACFSNNLLRREPLKLVDGGHSQRTFIYIKDAIEAVLLMIENPARANGHTFNVGNPNNEVTVRQLAEMMSQVYSKVSGEASIEVPTVDVSSKEFYGEGYDDSDKRIPDMTIINRQLGWNPKTSLWDLLESTLTYQHRTYAEAVKQAMSKTTAN

SEQ ID NO: 7161 - protein, 389 aa, Senecio madagascariensis
MTSSTARVDLDGNAIKPMTICMIGAGGFIGSHLCEKLMSETNHTVLAVDVYNDKIKHLLEPESLPWAGRIQFHRLNIKNDSRLEGLIKCSDLTINLAAICTPADYNTRPLDTIYSNFIDALPVVKYCSENNKRLIHFSTCEVYGKTIGSYLPKDSPLRQDPAYYILKEDTSPCIFGSVEKQRWSYACAKQLIERLIYAEGAENGLEFTIVRPFNWIGPRMDFIPGIDGPSEGVPRVLACFSNNLLRREPLKLVDGGESQRTFIYIKDAIEAVMLMIENPARASGHIFNVGNPDNEVTVRQLAEMMTQVYSKVSGEDSIETPTIDVSSQEFYGEGYDDSDKRIPDMTIINKQLGWNPKTSLWDLLESTLTYQRRTYAEAIKKAIAKPATN

SEQ ID NO: 7162 - protein, 393 aa, Artemisia annua
SSPSSSPSPVRLDLDGNTIKPLTICMIGAGGFIGSHLCEKLMNETNHTVLAVDVYNDKIKHLLEPESAPWTGRIQFHRLNIKNDSRLEGLIKCSDLTINLAAICTPADYNTRPLDTIYSNFIDALPVVKYCSENNKRLIHFSTCEVYGKTIGSYLPKDSPLRQDPAYYILKEDTSPCIFGSVEKQRWSYACAKQLIERLIYAEGAENGLEFTIVRPFNWIGPRMDFIPGIDGPSEGVPRVLACFSNNLLRREPLKLVDGGESQRTFIYIKDAIEAVLLMIENPARASGHIFNVGNPNNEVTVRQLAEMMTQVYSKVSGEDSIETPTVDVSSKEFYGEGYDDSDKRIPDMTIINKQLGWNPKTSLWDLLESTFTYQHRTYAEAIKQAIAKPAAN

SEQ ID NO: 7163 - protein, 181 aa, Aquilegia formosa
LINPLTICMIGAGGFIGSHLCEKLMEETNHKVLAIDVYNDKIKHLLEPQQNGATSQFVDRIQFYRINIKHDSRLENLIKMADLTINLAAICTPSDYNTRPLDTIYSNFIDALPVVKYCSENNKRLIHFSTCEVYGKTIGSFLPKDHPLRLDPEFYLLKEDSSPCILAPSRSKGGHMHAQSS

SEQ ID NO: 7164 - protein, 218 aa, Aquilegia formosa
MYFGSIEKQRWSYACAKQLIERLIYAEGAENGLEFTIVRPFNWIGPRMDFIPGIDGPSEGVPRVLACFSNNLLRGEPLKLVDGGQSQRTFVYIKDAIEAVHLMIENPGRANGHIFNVGNPNNEVTVKQLAEMMTEVYSKVSGEPALDVPTIDVSSKEFYGEGYDDSDKRIPDMTIINRQLGWNPKTSLWDLLESTLTYQHKTYAEAIKQAIAKPAASS

SEQ ID NO: 7165 - protein, 369 aa, Triphysaria pusilla
MHDRRRGFIGSHLCEKLMSETPHKVLAVDVYNDKIKHLLEPSSLAWADRIQFHRLNIKNDSRLEGLIRMADLTINLAAICTPADYNTRPLDTIYSNFIDALPVVKYCSENRKRLIHFSTCEVYGKTIGSFLPKDSPLRQDPNYYILKENDSPCIFGSIEKQRWSYACAKQLIERLVYAEGAENGLDFTIVRPFNWIGPRMDFIPGIDGPSEGVPRVLACFSNNLLRGEPLKLVDGGESQRTFIYIKDAIEAVLLMIENPARANGHIFNVGNPNNEVTVRQLAEMMTEVYTKVSGEPALDSPTIDISSKEFYGEGYDDSDKRIPDMTIINKQLGWNPKTSLWDLLESTLTYQHRTYAEAVKKATSKPLAS

SEQ ID NO: 7166 - protein, 386 aa, Cryptomeria japonica
MAGRVDLDGSPIDAITICMIGGGGFIGSHLCERLMHDTNHTVLAVDVYSDKIEHLLQPGQPWSSRIQFHRINIKHDPRLEGLIKMADLTINLAAICTPADYNTRPLDTIYSNFIDALPVVKYCSENNKRLIHFSTCEVYGKTIGSFLPKDHPLRQDPSFYVLKEDESPCIFGPIEKQRWSYACAKQLIERLIYAEGAENGLEFTIVRPFNWIGPRMDFIPGIDGPSEGVPRVLACFSNGLLRGEPLKLVDGGQSQRTFVYIKDAIEAVLRMIENPSRATGHIFNVGNPNNEVTVRQLAELMTEVYSKVSGKPPLDMPTIDVSSKEFYGEGYDDSDKRIPDMTIIKQQLEWEPKTSLSDLLEFTLTYQHKTYSHAVKQAMSKATASS

SEQ ID NO: 7167 - protein, 387 aa, Pinus taeda
MAVRRTDLDGGEILPMTICMIGAGGFIGSHLCEKLMHETDHTVLAIDVYSDKIQHLLEPGHPWSGRIEFHRINIKHDSRLEGLIKMADLTINLAAICTPADYNTRPLDTIYSNFIDALPVVRYCSENSKRLIHFSTCEVYGKTIGSFLPKDSPLRQDPAFYVLKEDVSPCIFGPIEKQRWSYACAKQLIERVIYAEGAENGLEFTIVRPFNWIGPRMDFIPGVDGPSEGVPRVLACFSNGLLRGEPLKLVDGGQSQRTFLYIKDAIEAVLLMIENPSRANGHIFNVGNPNNEATVKQLAEMMTEVYSKVSGQPPLEEPTVDISSQEFYGEGYDDSDKRIPDMTIIKERLGWDPKTSLWDLLDYTLTYQHKTYSQAVKQAMSTSIATS

SEQ ID NO: 7168 - protein, 387 aa, Picea glauca
MAVRRTDLDGGEILPMTICMIGAGGFIGSHLCEKLMSETDHTVFAIDVYSDKIQHLLEPGLPWSGRIEFHRINIKHDSRLEGLIKMADLTINLAAICTPADYNTRPLDTIYSNFIDALPVARYCSENSKRLIHFSTCEVYGKTIGSFLPKDSPLRQDPAFYVLKEDASPCIFGPIEKQRWSYACAKQLIERVIYAEGAENGLEFTIVRPFNWIGPRMDFIPGVDGPSEGVPRVLACFSNGLLRGEPLKLVDGGQSQRTFLYIKDAIEAVLLMIENPSRANGHIFNVGNPNNEVTVKQLAEMMTEVYSKVSGQPPLEVPTVDISSQEFYGEGYDDSDKRIPDMTIIKERLGWDPKTSLWDLLDYTLTYQHKTYSHAVKQAMSTSIASS

SEQ ID NO: 7169 - protein, 391 aa, Hordeum vulgare
MASGGRVDLDGGAVAPLTICMIGAGGFIGSHLCEKLMAETQHVVLAVDVYSDKIRHLVDPPPPHLAGRISFHRLNIKNDPRLEGLVKMADLTINLAAICTPADYNTRPLDTIYSNFIDALPVVKYCSENGKRLIHFSTCEVYGKTIGSFLPKDHPLRKEAEFYVLTEDESPCIFGPIVKQRWSYACAKQLIERLVFAEGAENGLDFTIVRPFNWIGPRMDFIPGVDGPSEGVPRVLACFSNNLLRREPLKLVDGGESQRTFVYIKDAIEAVLLMIENPARANGHIFNVGNPDNEVTVRELAEMMTEVYAKVSGEPPLEEPVIDVSAKEFYGEGYDDSDKRIPDMTLINKQLGWNPKTPLKDLLETTLTYQHKTYKEAVKTQMCLATATPSS

SEQ ID NO: 7170 - protein, 390 aa, Panicum virgatum
MSSPPARMDLDGNPVAPLTICMIGAGGFIGSHLCEKLMAETAHVVLAVDVYCDKIRHLVDPAPPHLAGRISFHRLNIKNDSRLEGLIKMADLTINLAAICTPADYNTRPLDTIYSNFIDALPVVKYCSENNKRLIHFSTCEVYGKTIGSFLPKDHPLRKEPEFYVLKEDESPCIFGPIVKQRWSYACAKQLIERLIFAEGAENGLEFTIVRPFNWIGPRMDFIPGVDGPSEGVPRVLACFSNNLLRREPLKLVDGGQSQRTFVYIKDAIEAVVLMIENPARANGHIFNVGNPNNEVTVRELAQMMTEVYANVSGEAPLDEPMIDVSSSQFYGEGYDDSDKRIPDMTIINKQLGWNPKTPLKDLLETTLTYQHKTYKEAVKRQMSQASASS

SEQ ID NO: 7171 - protein, 225 aa, Medicago truncatula
MLKEDESPCIFGPIEKQRWSYACAKQLIERLIYGEGDEKGLEFTIVRPFNWIGPRMDFIPGVDGPSEGVPRVLACFSNNLLRGEPLKLVDGGESQRTFLYIKDAIEAVLLMIENPARANGKIFNVGNPNNEVTVRELAEMMIKVYSKVSGDQPLETPTIDVSSKEFYGEGYDDSDKRIPDMTIINKQLGWNPKTSLEDLLESTLTYQHKTYAEAIKKVIAQTIAS

SEQ ID NO: 7172 - protein, 394 aa, Zea mays
MSSSPSPAATRLDLDGNPIAPLTICMIGAGGFIGSHLCEKLMAETHHTVLAVDVYCDKIRHLVDPAPPHLAGRISFHRLNIKNDSRLEGLIKMADLTINLAAICTPADYNTRPLDTIYSNFIDALPVVKYCSENSKRLIHFSTCEVYGKTIGSFLPKDHPLRKEPEFYVLKEDESPCIFGPIVKQRWSYACAKQLIERLVFAEGAENGLDFTIVRPFNWIGPRMDFIPGVDGPSEGVPRVLACFSNNLLRREPLKLVDGGQSQRTFVYIKDAIEAVVLMIENPARANGHIFNVGNPNNEVTVRELAQMMTEVYANVSGEAPLDEPMIDVSSSQFYGEGYDDSDKRIPDMTIINKQLGWNPKTPLKDLLETTLTYQHKTYKEAVKRQMSQASAST

SEQ ID NO: 7173 - protein, 393 aa, Brachypodium distachyon
MSSSPGSLGRTDLDGNPVAPLTICMIGAGGFIGSHLCEKLMAETAHVVLAVDVYCDKIRHLVDPAPPHLSGRISFHRLNIKNDSRLEGLIKMADLTINLAAICTPADYNTRPLDTIYSNFIDALPVVKYCSENNKRLIHFSTCEVYGKTIGSFLPKDHPLRKEAEFYVLKEDESPCIFGPIVKQRWSYACAKQLIERLIFAEGAENDLEFTIVRPFNWIGPRMDFIPGVDGPSEGVPRVLACFSNNLLRREPLKLVDGGESQRTFVYIKDAIEAVHLMIENPARANGHIFNVGNPDNEVTVRELAEMMIEVYANVSGEPPLDEPLIDVSAKQFYGEGYDDSDKRIPDMTLINKQLGWNPKTPLKDLLETTLTYQHKTYKEAVKRQMSQATASS

SEQ ID NO: 7174 - protein, 217 aa, Centaurea maculosa
  misc_feature (202)..(202): Xaa can be any naturally occurring amino acid
  misc_feature (209)..(210): Xaa can be any naturally occurring amino acid
MAASSARVDLDGNTIKPFTICMIGAGGFIGSHLCEKLMSETPHTVLAVDVYNDKIKHLLEPDSLPWAGRIQFHRLNIKNDSRLEGLIKRSDLTVNLAAICTPADYNTRPLDTIYSNFIDALPVGNYCSKNNKRLIHFSTCKVYGKTIGSYLPKYSPLRQDPAYYILQQYTSPCIFGSIEKHMWSYACAKQSIERLIYAEGAXMVSSSHXXAFQLDWP

SEQ ID NO: 7175 - protein, 399 aa, Saccharum officinarum
PTRRAPIPRTPRRGASRAHSPNPIAPLTICMIGAGGFIGSHLCEKLMAETRHVVLAVDVYCDKIRHLVDPAPPHLAGRISFHRLNIKNDSRLEGLIKMADLTINLAAICTPADYNTRPLDTIYSNFIDALPVVKYCSENSKRLIHFSTCEVYGKTIGSFLPKDHPLRKEPEFYVLKEDESPCIFGPIVKQRWSYACAKQLIERLIFAEGAENDLEFTIVRPFNWIGPRMDFIPGVDGPSEGVPRVLACFSNNLLRREPLKLVDGGQSQRTFVYIKDAIEAVVLMIENPARANGHIFNVGNPDNEVTVRELAQMMTEVYANVSGEAPLDEPMIDVSSSQFYGEGYDDSDKRIPDMTIINKQLGWNPKTPLKDLLETTLTYQHKTYKEAVKRQMSQASATS

SEQ ID NO: 7176 - protein, 398 aa, Oryza sativa
MSSSSSPPAASAAARLDLDGNPIAPLTICMIGAGGFIGSHLCEKLMAETAHVVYAVDVYCDKIRHLVDPAPPHLHGRISFHRLNIKNDSRLEGLIKMADLTINLAAICTPADYNTRPLDTIYSNFIDALPVVKYCSENNKRLIHFSTCEVYGKTIGSFLPTDHPLRKEPEFYVLKEDESPCIFGPIVKQRWSYACAKQLIERLIFAEGAENGLEFTIVRPFNWIGPRMDFIPGVDGPSEGVPRVLACFSNNLLRREPLKLVDGGQSQRTFVYIKDAIEAVHLMIENPARANGQIFNVGNPNNEVTVRQLAEMMTEVYANVSGEPPLDEPMIDVSSKQFYGEGYDDSDKRIPDMTIINKQLGWNPKTPLKDLLETTLTYQHKTYKEAIKRQMSQASASS

SEQ ID NO: 7177 - protein, 397 aa, Sorghum bicolor
MSSSSPSPAAAAARLDLDGNPIAPLTICMIGAGGFIGSHLCEKLMAETRHVVLAVDVYCDKIRHLVDPAPPHLAGRISFHRLNIKNDSRLEGLIKMADLTINLAAICTPADYNTRPLDTIYSNFIDALPVVKYCSENSKRLIHFSTCEVYGKTIGSFLPKDHPLRKEPEFYVLKEDESPCIFGPIVKQRWSYACAKQLIERLIFAEGAENGLEFTIVRPFNWIGPRMDFIPGVDGPSEGVPRVLACFSNNLLRREPLKLVDGGQSQRTFVYIKDAIEAVVLMIENPARANGHIFNVGNPDNEVTVRELAQMMTEVYANVSGEAPLDEPMIDVSSSQFYGEGYDDSDKRIPDMTIINKQLGWNPKTPLKDLLETTLTYQHKTYKEAVKRQMSQASSTS

SEQ ID NO: 7178 - protein, 400 aa, Pennisetum glaucum
MSPPPPPPSPSPAPARLDLDGNPVAPLTICVIGAGGFIGSHLCEKLMAETAHAVLAVDVYCDKIRHLVDPAPPPHLAGRISFHRLNIKNDSRLEGLIKMADLTINLAAICTPADYNTRPLDTIYSNFIDALPVVKYCSENSKRLIHFSTCEVYGKTIGSFLPKDHPLRKEPEFYVLKEDESPCIFGPIVKQRWSYACAKQLIERLVFAEGAENGLEFTIVRPFNWIGPRMDFIPGVDGPSEGVPRVLACFSNNLLRREPLKLVDGGQSQRTFVYIKDAIEAVVLMIENPARANGHIFNVGNPNNEVTVRELAQMMTEVYANVSGEAPLDEPMVDVSSSQFYGEGYDDSDKRIPDMTIINKQLGWNPKTPLKDLLETTLTYQHKTYKEAVKRQMSQASASS

SEQ ID NO: 7179 - protein, 344 aa, Nicotiana tabacum
  misc_feature (67)..(67): Xaa can be any naturally occurring amino acid
  misc_feature (80)..(80): Xaa can be any naturally occurring amino acid
  misc_feature (97)..(98): Xaa can be any naturally occurring amino acid
  misc_feature (117)..(117): Xaa can be any naturally occurring amino acid
  misc_feature (119)..(119): Xaa can be any naturally occurring amino acid
  misc_feature (125)..(125): Xaa can be any naturally occurring amino acid
  misc_feature (132)..(132): Xaa can be any naturally occurring amino acid
LAVDVYSDKIKHLLEPATLPWADRIQFHRINIKNDSRLEGLIKMADLTINLAAICTPADYNTRPLDXIYSNFIDALPVVXYCSENGKRLIHFSTCEXXGKTIGAFLPKDSPLRQDPXYXVLKEDXSPCIFGXIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPARANGHIFNVGNPNNEVTVRQLAEMMTQVYSKVSGESSIETPTIDVSSKEFYGEGYDDSDKRIPDMTIINRQLGWNPKTSLWDLLESTLTYQHRTYAEAVKQAMSKTTAN

SEQ ID NO: 7180 - protein, 396 aa, Zea mays
MSSSLSPAAAAAPLDLDGNSVAPLTICMIGAGGFIGSHLCEKLMAETRHVVLAVDVYCDKIRHLVDPAPPHLAGRISFHRLNIKNDSRLEGLIKMADLTINLAAICTPADYNTRPLDTIYSNFIDALPVVKYCSENSKRLIHFSTCEVYGKTIGSFLPKDHPLRKEPEFYVLKEDESPCIFGPIVKQRWSYACAKQLIERLIFAEGAENGLEFTIVRPFNWIGPRMDFIPGVDGPSEGVPRVLACFSNNLLRREPLKLVDGGQSQRTFVYIKDAIEAVVLMIENPARANGHIFNVGNPDNEVTVRELAQMMTEVYANVSGEAPLDEPMIDVSSSQFYGEGYDDSDKRIPDMTIINKQLGWNPKTPLKDLLETTLTYQHKTYKEAVKRQMSQASATS

SEQ ID NO: 7181 - protein, 389 aa, Arabidopsis thaliana
MADNTDNRRSLWGVPEKLQLHIAMLTLQFGYAGFHVVSRAALNMGISKLVFPVYRNIIALLLLLPFAYFLEKKERPAITLNFLIQFFFLALIGITANQGFYLLGLDNTSPTFASSMQNSVPAITFLMAALLRIEKVRINRRDGISKILGTALCVAGASVITLYKGPTIYTPASHLHAHLLTTNSAVLAPLGNAAPKNWTLGCIYLIGHCLSWSGWLVFQAPVLKSYPARLSVTSYTCFFGIIQFLIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAAIQSSAEHGIERAPVSRNSIKSSITTPLLHQSTDNV

SEQ ID NO: 7182 - protein, 391 aa, Arabidopsis lyrata
MADNTGNDNRRSIWGVPEKLQLHIAMLTLQFGYAGFHVVSRAALNMGISKLVFPVYRNIIALLLLLPFAYFLEKKERPAITLNFLIQFFFLALIGITANQGFYLLGLDNTSPTFASSMQNSVPAITFLMAALLRIEKVRINRRDGISKVLGTALCVAGASVITLYKGPTIYTPTSHLHTHLLTTNSAVLAPLGDAAPKNWTLGCIYLIGHCLSWSGWLVFQAPVLKSYPARLSVTSYTCFFGIIQFLIIAAFCERESQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKATIQSSAEHGIERAPVSRNSIKSSITTPLLHQSTDNV

SEQ ID NO: 7183 - protein, 389 aa, Brassica rapa
MADNTDNRRAIWGVPEKLQLHIAMLTLQFGYAGFHVVSRAALNMGISKLVFPVYRNIIALLLLLPFAYFLEKKERPAITLNFLIQFFFLALIGITANQGFYLLGLDYTSPTFASSMQNSVPAITFLMAALLRIERVRLNRRDGISKVLGTALCVAGASVITLYKGPTIYTPTSHLHAHLLTTNPAVLAPLGDAAPKNWTLGCLYLIGHCLSWSAWLVFQAPVLKKYPARLSVTSYTCFFGIIQFLIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAEIQTIVEHGIERVPVSRGSIKSSITVPLLHQSTDNV

SEQ ID NO: 7184 - protein, 384 aa, Ricinus communis
MADTGGSVSSRRMWCSVPERLQLHMAMLTLQFGYAGFHVVSRAALNMGISKLVFPVYRNIIALLLLLPFAYFLEKKERPAITLNFIIQFFLLALIGITANQGFYLLGLDNTSPTFASAIQNSVPAITFLMAALLRIEKVRLDRKDGIAKVIGTICCVAGASVITLYKGPVVYSPVPPLNKPTPMFVSLGDARGKNWTLGCIYLIGHCLSWSGWLVLQAPVLKKYPARLSVTSYTCFFGLIQFLIIAAIFERDTQAWMFHSGGELFTILYAGVVASGIAFAVQIWCIDRGGPVFVAVYQPVQTLVVAIMASIALGEEFYLGGMIGAVLIIIGLYLVLWGKSEEKKFAAKESAAIQSSADHASIRSQAHIKTSLTQPLLPSSTENV

SEQ ID NO: 7185 - protein, 496 aa, Brassica napus
MGMIGLLEVFAAFLFFLVFKHFFLHKKSPGQPIIKSWPVLGMLPGMLPHIPRIFEWTFEVLEATNLTFFFKGPWLSGTDMLFTADPRNIHHILSLNFGNYPKGPEFKKIFDVLGDGILSVDLELWEDLRKSNHAMFHHPDFLELSVSSNTSKLKEGLVPFLDNAAHEKIVIDLQDVFKRFMFDTSSILMTGYDPMSLSIEMPEVEFGEAAETGEEAIYYRHFKPVILWRLQNWLGIGLERKMRSSLVTVNRMFAKIISTRREELSRGESKQSADALTYYMNVDTTKYRLLKPSNDTFIRDVAFSLVLSGRDTTSSALTWFFWLLSMHPQVLSKIRKEINTKYDPTDLEKLVYLHAALSETMRLYPPLPFNHKSPAKPDVLPSGHKVEANSKIVICIYALGRMRSIWGEDAFDFKPERWISKSGELKHEPSYKFMAFNAGPRACLGKHLALLQMKIVAVEIIQNYDFKVTEGHKIEAVPSIVLRMKHGLNVTVTKQI

SEQ ID NO: 7186 - protein, 485 aa, Brassica rapa
  misc_feature (469)..(469): Xaa can be any naturally occurring amino acid
MGMIGLLEVFAAFLFFLVFKHFFLHKKSPRQPILKSWPVLGMLPGMLPHIPRIFEWTFEVLEATNLTFFFKGPWLSGTDMLFTADPRNIHHILSLNFGNYPKGPEFKKIFDVLGDGILSVDLELWEDLRKSNHAMFHHPDFLELSVSSNTSKLKEGLVPFLDNAAHENIVIDLQDVFKRFMFDTSSILMTGYDPMSLSIEMPEVEFGEAAETGEEAIYYRHFKPVILWRLQNWLGIGLERKMRSSLVTVNRMFAKIISTRREEISRGERKQSADALTYYMNVDTTKYRLLKPSNDTFIRDVAFSLVLSGRDTTSSALTWFFWLLSMHPQVLSKIRKEINTKYDPTDLEKLVYLHAALSETMRLYPPLPFNHKSPAKPDVLPSGHKVEANSKIVICIYALGRMRSIWGEDALDFKPERWISKGGELKHEPSYKFMAFNAGPRACLGKHLALLQMKIVAVEIIQNYDFKVXEGHKIGSSPFYRSPYE

SEQ ID NO: 7187 - protein, 496 aa, Raphanus sativus
  misc_feature (86)..(86): Xaa can be any naturally occurring amino acid
MAIIGLLEVFVAFLFSLVFKKFFLHMKSPGHPVLKSWPVLGMLPGMLPHIPRIFDWTYEVLDATNLTFFFKGPWLSGTDMLFTADXRNINHILNLNFGNYPKGPEFQKIFDVLGDGILSVDMELWEDLRKSNYVLFHHPDFLELSVSSNTSKLKEGLVPFLDNAAEENIVIDLQDLFKRFMFDTSSILMTGYDPMSLSIEMPEVEFGEAAETGEEAIYYRHFKPVTLWRLQNWLGIGLERKMRSSLATVNRMFAKIISTRREEIRRGEGVQSMDALTYYMNVDTTKYKLLKPSDDTFIRDVAFSLVLAGRDTTSSVLTWFFWLLSKHPQVLSKIREEIKTKYDPKDLEKLVYLHATLNETMRLYPPLPFNHKSPAKPDVLPTGHKVEENSKIVLCMYALGRMRSIWGKDALDFKPERWISESGDLRHEPSYKFMAFNAGPRACLGKNLALAQMKMVAVEIIRNYDFKVTEGHKIEAIPSILLRMKHGLCVTVTKKI

SEQ ID NO: 7188 - protein, 135 aa, Raphanus sativus
MSYEKELAAAKKAVSLAARLSRGVQKTLLQSEVWSKSNNTPVTAADYGSQAVVSIVLERELKPVTLSLVAEEDTGDLRKEGSEVFLEGITKLVRETLASDESYADSPVSTEDVLNAIDCGKSEGGGSGCHWVLIL

SEQ ID NO: 7189 - protein, 407 aa, Brassica napus
PKSLKPLLPVFLQGLISGSAELREQAALGLGELIEVTSEEALKEFVIPITGPLIRIIGDRFPWQVKSAILATLIILIQRGGMALKPFLPQLQTTFVKCLQDSTRTIRSSAALALGKLSALSTRIDPLVGDLTTSFVAADSGVREAILSAMRGVIKHAGKSIGPAVRIRIFDLIKELMHNDDDQVRIFATSMLGVLSQYLEAAQVSVLLQEIISLSTSPKWSSRHGSVLCIASLLKHNPSTIMTSSLFSAVLNSLKISLKDEKFPLRETSTKALGRLLLHQLAMEPSSTGRVVIDILSSIVSALHDDSSEVRRRALSSLKAFAKNNPAATIANVSVIGPPLAECLKDGSTPVRLAAERCAMHVFQLTKGAENVQAAQKYITGLDARRLSKLPEQSDDSDDSEDDDGRG

SEQ ID NO: 7190 - protein, 400 aa, Brassica rapa
  misc_feature (266)..(266): Xaa can be any naturally occurring amino acid
  misc_feature (314)..(314): Xaa can be any naturally occurring amino acid
  misc_feature (332)..(332): Xaa can be any naturally occurring amino acid
LPVFLQGLISGSAELREQAALGLGELIEVTSEEALKEFVIPITGPLIRIIGDRFPWQVKSAILATLIILIQRGGMALKPFLPQLQTTFVKCLQDPTRTIRSSAALALGKLSALSTRIDPLVGDLTTSFVAADSGVREAILSAMRGVIKHAGKSIGPAVRIRIFDLIKELMHNDDDQVRIFATSMLGVLSQYLEAAQLSVLLQEIISLSTSPKWSSRHGSVLCIASLLKHNPSTIMTSPLFSAVLNSLKSSLKDEKFPLRETSTKAXGRLLLHQLAIEPSNTARVVIDILSSIVSALHDDSSEVRRRALSSLKAXAKNNPAATIANVSVIGPXLAECLKDGSTPVRLAAERCAMHVFQLTKGAENVQAAQKYITGLDARRLSKLPEQSDDSDDSEDDDGRG

SEQ ID NO: 7191 - protein, 381 aa, Brassica napus
ALGLGELIEVTSEEALKEFVIPITGPLIRIIGDRFPWQVKSAILATLIILIQRGGMALKPFLPQLQTTFVKCLQDSTRTIRSSAALALGKLSALSTRIDPLVGDLTTSFVAADSGVREAILSAMRGVIKHAGKSIGPAVRIRIFDLIKELMHNDDDQVRIFATSMLGVLSQYLEAAQVSVLLQEIISLSTSPKWSSRHGSVLCIASLLKHNPSTIMTSSLFSAVLNSLKISLKDEKFPLRETSTKALGRLLLHQLAMEPSSTGRVVIDILSSIVSALHDDSSEVRRRALSSLKAFAKNNPAATIANVSVIGPPLAECLKDGSTPVRLAAERCAMHVFQLTKGAENVQAAQKYITGLDARRLSKLPEQSDDSDDSEDDDGRG

SEQ ID NO: 7192 - protein, 2501 aa, Arabidopsis lyrata
MTSDIAPVLVDMIFQTLAIYDDRASRKAVDDLIVEGLENVTFMKTFAAMLVQVMEKQLRFCFDTVCYRLLIWSCLLLGKSQFATVSKNAFVRVASTQASLLRIIMESSFRMRRACKRFMFHLFSQSQAIYSLYMDEVKGSRIPYKDSPELLGLLLEFSCSSPALFEQSKAIFADIYVKDVLNSREKQKQNLSNCFKPLLQRLSHEEFQTVILPAAVKMLKRNPEIVLEAVGFLLANVNIDLSKYALELLPVILPQARHTDEDRRHGALSMVRCLSEKSSNPDTIEAMFASVKAIIGVQELASAPEGKYIGSLSRTICSFLIACYKDEASWASRSSDAIQPNLVSFIAAGLKEKEALRRGHLRCISDLLSPLIQLVKTGFTKAVQRLDGIYALLIVSKIAACDIKAEDTMVKEKLWTLISLNEPSLVQITLASKLSSDDCEVCADLLEVLLVEHSSRVLEAFSLKSLSQLLLFLLCHPSWNVRKTAYNAVTKIFLATSQLATTLLDEFSDFLSITGDQLVSSRTSDADNPVDHQAPFVPSVEVLVKALIVISSAAVAGPPSSWIVRAIFCSHHPSIVGTGKRDAVWKSLLGPMGLMSPKTPEQQAAVYSLSTMMSLAPEDTFTVFKMHLQDLPDRLSHDMLSETDIKIFHTPEGMLLSEQGIYVAQTIGAKYTKQEPSSNHSLKKGLASRETANSGRRDTAKLTKKADKGKTAKEEARELMLKEEASTRENVHRIQKSLSLVLHALGEMGLANPVFCHSQLPFLATFLDPLLRSPIVSAAAFENLVKLARCTVQPLCNWALEISTALRLIAIDEVDTSSDFRPSVDKAGKTYEGLFERIVNGLSISCKSGPLPVDTFTFIFPILERILLSSKRTKLHDDVLQILYMHLDPMLPLPRLRMISVLYHVLGVVPAYQASVGPALNELCLGLQADDVANALYGVYSKDVHVRMACLNAVKCIPAVSKCSLPQNVNIATNIWIALHDPEKSVAESADDLWARYGHDLGTDYSGIFKALSHINLNVRLAAAEALADALHESPASIQLSLSTLFSLYIRDATSGEDVFDAGWIGRQGIALALQSAADVLTTKDLPAVMTFLISRALADPNTDVRGKMINAGTMIIDKHGKENVSLLFPIFENYLNKEASDEEEYDLVREGVVIFTGALAKHLAKDDPKVHNVVEKLLEVLNTPSESVQRAVSTCLSPLVLSKQEDAPALFLRLLDKLMKSDKYGERRGAAFGLAGVVMGFGISSLKKYGLIVNLQEALIDRNSAKRREGALLAFECLCEKLGKLFEPYVIKMLPLLLVSFSDQVGAVREAAECAARAMMSQLSAYGVKLVLPSLLKGLDDKAWRTKQSSVQLLGAMAFCAPQQLSQCLPRVVPKLTEVLTDTHPKVQSAGQLALQQVGSVIKNPEISSLVPTLLLALTDPNEYTRHSLDTLLQTTFVNSVDAPSLALLVPIVHRGLRERSSETKKKASQIVGNMCSLVTEPKDMIPYIGLLLPEVKKVLVDPIPEVRSVAARAVGSLIRGMGEDNFPDLVPWLFETLKSDTSNVERYGAAQGLSEVIAALGTDYFENILPDLIRHCSHQKASVRDGYLTLFKFLPRSLGAQFQKYLQLVLPAILDGLADENESVRDAALGAGHVLVEHHATTSLPLLLPAVEDGIFNDNWRIRQSSVELLGDLLFKVAGTSGKALLEGGSDDEGASTEAQGRAIIDILGMDKRNEVLAALYMVRTDVSLSVRQAALHVWKTIVANTPKTLKEIMPILMSTLISSLASPSSERRQVAGRSLGELVRKLGERVLPLIIPILSKGLKDPDVDKRQGVCIGLNEVMASAGRSQLLSFMDQLIPTIRTALCDSALEVRESAGLAFSTLYKSAGLQAMDEIIPTLLEALEDDEMSTTALDGLKQIISVRTAAVLPHILPKLVHLPLSALNAHALGALAEVAGTGFNTHLGTILPALLSAMGDENKEVQELAQEAAERVVLVIDEEGVETLLSELLKGVSDSQASIRRSSAYLIGYFFKSSKLYLIDEAPNMISTLIVMLSDSDSTTVAVSWEALARVIGSVPKEVLPSYIKLVRDAVSTARDKERRKRKGGYVVIPGLCLPKSLKPLLPVFLQGLISGSAELREQAAIGLGELIEVTSEQALKEFVIPITGPLIRIIGDRFPWQVKSAILATLIILIQRGGMALKPFLPQLQTTFVKCLQDSTRTIRSSAALALGKLSALSTRIDPLVGDLMTSFQAADSGVQEAILSAMRGVIKHAGKSIGPAVRVRIFDLLKDLMHHEDDQVRISATSMLGVLSQYLEAAQLSVLLQEVKDLSASQNWGTRHGSVLCISSLLKYNPSTIMTSSLFSSMLNSLKSSLKDEKFPLRESSTKALGRLLLRQLATDPSNTKVVIDVLSSIVSALHDDSSEVRRRSLSSLKAFAKDNPSATMANISVIGPPLTECLKDGNTPVRLAAERCALHVFQLTKGAENVQAAQKYITGLDARRLSKFPEQSDDSESDDDNVSG

SEQ ID NO: 7193 - protein, 365 aa, Raphanus sativus
  misc_feature (138)..(138): Xaa can be any naturally occurring amino acid
  misc_feature (147)..(147): Xaa can be any naturally occurring amino acid
KEFVIPITGPLIRIIGDRFPWQVKSAILATLIILIQRGGMALKPFLPQLQTTFVKCLQDSTRTIRSSAALALGKLSALSTRIDPLVGDLMTSFLAADSGVREAILSAMRGVIKHAGKSIGPAVRIRIFDLIKELMHNXDDQVRIFAXSILGILSQYLEAAQLSVLLQEVISLSASQKWSSRHGSVLCIASLLKHNPSTIMTSSLFSALLNSLKSSLKDEKFPLRETSTKALGRLLLHQLAVEPSSTARVVIDVLSSIVSALHDDSSEVRRRALSSLKAFAKNNPAATSDNVSVIGPPLAECLKDGSTPVRLAAERCAMHVFQLTKGAENVQAAQKYITGLDARRLSKLPEQSDDSDDSEDDNGRG

SEQ ID NO: 7194 - protein, 660 aa, Brassica rapa
  misc_feature (354)..(354): Xaa can be any naturally occurring amino acid
  misc_feature (371)..(371): Xaa can be any naturally occurring amino acid
MKSFAAKVEEGVKGENGKPSVGPVYRNLLSEKGFPPIDSDITTAWDIFCKSVEKFPGNKMLGWRPIVDKKVGPYVWKTYKEAYEEVLQIGSALRALGAEPGCRVGIYGINCPQWIIAMEACAAHTLICVPLYDTLGSGAVDYIVDHAEIDFVFVQDTKIKGLLEPDSICSKRLKAIVSFTNVSKEDSIKASEIGVKTYSWLDFLHMGREKPEEISPPKPFNTCTIMYTSGTSGDPKGVVLTHEAVATFVVGVDLFMDQFEDKMTHEDVYLSFLPLAHILDRMNEEYFFRKGASVGYYHGDLNVLRDDIQELKPTYLAGVPRVFERIHEGIQKALQELNPRRRFIFNALYKHKLXWLNRGYSHSKASPMADXIAFRKIRDKLGGRIRLLVSGGAPLSTEIEEFLRVTCCCFVVQGYGLTETLGGTAMGFPDEMCMLGTVGIPAVYNEIRLEEVAEMGYDPLGENPAGEICIRGKCLFSGYYKNPELTQEVMKDGWFHTGDIGEIQSNGVLKIIDRKKNLIKLSQGEYVALENLENIYGQNSLVQDIWVYGDSFKSMLVAVIVPNQETVKRWAKELGFTKPFEELCSLSEFQEHIISELKSTAEKNKLRKFEYIKAVTVETKPFDVARDLVTATLKNRRNNLLKYYQVQVDEMYRKLASKKI

SEQ ID NO: 7195 - protein, 660 aa, Arabidopsis lyrata
MKSFAAKAEEGVKGIDGKPSVGPVYRNLLSEKGFPPIDSEITTAWDIFSKSVEKFPDNNMLGWRRIVDEKVGPYMWKTYKEVYEEVLQIGSALRAAGAEPGSRVGIYGVNCPQWIIAMEACAAHTLICVPLYDTLGSGAVDYIVEHAEIDFVFVQDTKIKGLLEPDCKCAKRLKAIVSFTNVSDELSHKASEIGVKTYSWIDFLHMGREKPEDTNPPKAFNICTIMYTSGTSGDPKGVVLTHQAVATFVVGMDLYMDQFEDKMTHDDVYLSFLPLAHILDRMNEEYFFRKGASVGYYHGNLNVLRDDIQELKPTYLAGVPRVFERIHEGIQKALQELNPRRRFIFNALYKHKLAWLNRGYSHSKASPMADFIAFRKIRDKLGGRIRLLVSGGAPLSPEIEEFLRVTCCCFVVQGYGLTETLGGTALGFPDEMCMLGTVGIPAVYNEIRLEEVSEMGYDPLGENPAGEICIRGQCMFSGYYKNPELTEEVMKDGWFHTGDIGEILPNGVLKIIDRKKNLIKLSQGEYVALEHLENIFGQNSVVQDIWVYGDSFKSMLVAVVVPNPETVNRWAKDLGFTKPFEELCSFPELKEHIISELKSTAEKNKLRKFEYIKAVTVETKPFDVERDLVTATLKNRRNNLLKYYQVQIDEMYRKLASKKI

SEQ ID NO: 7196 - protein, 660 aa, Arabidopsis lyrata
MKSFAAKAEEGVKGIDGKPSVGPVYRNLLSEKGFPPIDSEITTAWDIFSKSVEKFPDNNMLGWRRIVDEKVGPYMWKTYKEVYEEVLQIGSALRAVGAEPGCRVGIYGINCPQWIIAMEACAAHTLICVPLYDTLGSGAVDYIVEHAEIDFVFVQDTKIKGLLEPDCKCAKRLKAIVSFTNVSDELSHKASEIGVKTYSWIDFLHMGREKPEETNPPKALNICTIMYTSGTSGDPKGVVLTHQAVATFVVGMDIFMDQFEDKMTHDDVYLSFLPLAHILDRLNEEYFFRKGASVGYYHGDLNVLRDDIQELKPTYLAGVPRVFERIHEGIQKALQELNPRRRLIFNALYKHKLAWMNRGYSHSKASPMADFIAFRKIRDKLGGRIRLLVSGGAPLSPEIEEFLRVTCCCFVVQGYGLTETLGGTALGFPDEMCMLGTVGIPAVYNEIRLEEVAEMGYDPLGENPAGEICIRGQCMFSGYYKNPELTEEVIKDGWFHTGDIGEILPNGVLKIIDRKKNLIKLSQGEYVALEHLENIFGQNSVVQDIWVYGDSFKSMLVAVVVPNPETVNRWAKDLGFTKPFEELCSFPELKEHIISELKSTAEKNKLRKFEYIKAVAVETKPFDVERDLVTATLKNRRNNLLKYYQVQIDEMYRKLASKKI

SEQ ID NO: 7197 - protein, 660 aa, Brassica napus
MKSFAAKVEEGVKGENGKPSVGPVYRNLLSEKGFPPIDSEITTAWDIFCKSVEKFPGNKMLGWRPIVDKKVGPYVWKTYKEAYEEVLQIGSALRALGAEPGCRVGIYGINCPQWIIAMEACAAHTLICVPLYDTLGSGAVDYIVDHAEIDFVFVQDTKIKGLLEPDSICSKRLKAIVSFTNVSKEDSIKASEIGVKTYSWLDFLHMGREKPEEISPPKPFNTCTIMYTSGTSGDPKGVVLTHEAVATFVVGVDLFMDQFEDKMTHEDVYLSFLPLAHILDRMNEEYFFRKGASVGYYHGDLNVLRDDIQELKPTYLAGVPRVFERIHEGIQKALQELNPRRRFIFNALYKHKLSWLNRGYSHSKASPMADLIAFRKIRDKLGGRIRLLISGGAPLSPEIEEFLRVTCCCFVLQGYGLTETLGGTAMCIPDEMCMLGTVGIPAVYNEIRLEEVAEMGYDPLGENPAGEICIRGKCLFSGYYKNPKLTDEVLKDGWFHTGDIGEIQPNGVLKIIDRKKNLIKLSQGEYVALENLENIYGQNSLVQEIWVYGDSFKSMLVAVIVPNPEVVNRWAKDLGLNKPFEELCSLTELQEHIILELKSTAEKNKLKRFEYIKAVTVEIKPFDLERDLVTATLKNKRNNLLKYYQVQVDEMYRKLASKKI

SEQ ID NO: 7198 - protein, 660 aa, Brassica napus
MKSFAAKVEEGVKGENGKPSVGPVYRNLLSEKGFPPIDSEITTAWDIFCKSVEKFPGNKMLGWRPIVDKKVGPYVWKTYKEAYEEVLQIGSALRALGAEPGCRVGIYGINCPQWIIAMEACAAHTLICVPLYDTLGSGAVDYIVDHAEIDFVFVQDTKIKGLLEPDSICSKRLKAIVSFTNVSKEDSIKASEIGVKTYSWLDFLHMGREKPEEISPPKPFNTCTIMYTSGTSGDPKGVVLTHEAVATFVVGVDLFMDQFEDKMTHEDVYLSFLPLAHILDRMNEEYFFRKGASVGYYHGDLNVLHDDIQELKPTYLAGVPRVFERIHEGIQKALQELNPRRRFIFNALYKHKLSWLNRGYSHSKASPMADLIAFRKIRDKLGGRIRLLISGGAPLSPEIEEFLRVTCCCFVLQGYGLTETLGGTAMCIPDEMCMLGTVGIPAVYNEIRLEEVAEMSYDPLGENPAGEICIRGKCLFSGYYKNPKLTDEVLKDGWFHTGDIGEIQPNGVLKIIDRKKNLIKLSQGEYVALENLENIYGQNSVVQDIWVYGDSFKSMLVAVIVPNPEVVNRWAKDLGLNKPFEELCSLTELQEHIILELKSTAEKNKLKRFEYIKAVTVEIKPFDLERDLVTATLKNKRNNLLKYYQAQVDEMYRKLASKKI

SEQ ID NO: 7199 - protein, 109 aa, Brassica oleracea
MHTINLHFFIVSWPLASVRGRSLSRSLVRCAGFSAKLTTMTRGSQRERDRERAQARAGGKGKTKDDGLTPEQRRERDAKALQEKAAKKAAQAAGAATSGGGGKGNNNKK

SEQ ID NO: 7200 - protein, 100 aa, Brassica rapa
IVSWPLASVRERSLSRSLVGCAGFSAKLTTMTRGSQRERDRERAQARAGGKGKTKDDGLTPEQRRERDAKALQEKAAKKAAQAAGAATSGGGGKGNNNKK

SEQ ID NO: 7201 - protein, 70 aa, Brassica napus
MTRGSQRERDRERAQARAGGKEKTKDDGLTPEQRRERDAKALQEKAAKKAAQAAGAATSGGGGKGNNNKK

SEQ ID NO: 7202 - protein, 117 aa, Brassica napus
GVWNLKNIMHTINLLFFIVSWPLASVRGRSLSRSLVRCAGFSAKLTTMTRGSQRERDRERAQARAGGKEKTKDDGLTPEQRRERDAKALQEKAAKKAAQAAGAATSGGGGKGNNNKK

SEQ ID NO: 7203 - protein, 97 aa, Brassica napus
VSWPLASVRERSLSRSLVGCAGFSAKLTTMTRGSQRERDRERAQARAGGKGKTKDDGLTPEQRRERDAKALQEKAAKKAAAGAATSGGGGKGNNNKK

SEQ ID NO: 7204 - protein, 68 aa, Brassica napus
MTRGSQRERDRERAQARAGGKGKTKDDGLTPEQRRERDAKALQEKAAKKAAAGAATSGGGGKGNNNKK

SEQ ID NO: 7205 - protein, 72 aa, Brassica nigra
MTRGSQRERDRERAQARAGGKGKTKDDGLTPEQRRERDAKALQEKAAKKAAQAAGAAASGGAGGGKGNNNKK

SEQ ID NO: 7206 - protein, 71 aa, Raphanus sativus
MTRGSQRERDRERAQARAGGKGKTKDDGLTPEQRRERDAKALQEKAAKKAAQAAGSAASGGGGGKGNNNKK

SEQ ID NO: 7207 - protein, 70 aa, Thellungiella halophila
MTRGSQRERDRERAQARTGGKGKTKDDGLTPEQRRERDAKALQEKAAKKAAQAAGAASSGGGAKGNNNKK

SEQ ID NO: 7208 - protein, 73 aa, Brassica juncea
MTRGSQRERDRERAQARAGGKGKTKDDGLTPEQRRERDAKALQEKAAKKAAQAAGAAASGGGGGGGKGNNNKK

SEQ ID NO: 7209 - protein, 58 aa, Raphanus sativus
DCLLAFGFCKGEISLQISCWLSYAGFSAKAHHQSIIMTHILVDSFEFLFLQIFSCLVL

SEQ ID NO: 7210 - protein, 149 aa, Arabidopsis lyrata
MAKFIVIFIVFSFLFATQFSNEGGEGSLTIGQCPAACNVRCSATSHKKPCLFYCNYCCNKCLCVPSGTYGHKEECPCYNNWKTQEGSQRERDRERALARTGGKGKTKDDGLTPEQRRERDAKALQEKAAKKAAQAAAAASSGGGKGNNK

SEQ ID NO: 7211 - protein, 71 aa, Bruguiera gymnorhiza
MTRGNQRERDRERAQARASGKSGKTKDDGLTPEQRRERDAKALQEKAAKKAAQAAASGAESSGGGKGNNKK

SEQ ID NO: 7212 - protein, 98 aa, Arabidopsis thaliana
SSLSGFGSPSSEISDLSQDRLFATQISPAMTRGSQRERDRERALARTGGKGKNKDDGLTPEQRRERDAKALQEKTAKKAAQAAAAASSGGGGGKGNNK

SEQ ID NO: 7213 - protein, 69 aa, Arabidopsis thaliana
MTRGSQRERDRERALARTGGKGKNKDDGLTPEQRRERDAKALQEKTAKKAAQAAAAASSGGGGGKGNNK

SEQ ID NO: 7214 - protein, 70 aa, Brassica juncea
MTRGSQRERDRERAAARAGGKGKSADDGLTPEQRRERDGKALQEKAAKKAAQAAAAAGGSGGGGKGTAKK

SEQ ID NO: 7215 - protein, 68 aa, Cleome gynandra
MTRGNQRDRDRERAQARTSGKGKTKDDGLTPEQRRERDAKALQEKAAKKAAQADAGGTSGGGKGNNKK

SEQ ID NO: 7216 - protein, 66 aa, Catharanthus roseus
MTRGNQREKDRERAQARNGGKGKTKDDGLTPEQRRERDAKALQEKAAKKAAQAAGGSDAGGKSNKK

SEQ ID NO: 7217 - protein, 77 aa, Brassica juncea
LVSLRGFSLPKLTIIMTRGSQRERDRERAQARAGCKGKTKDDGLTPEQRRERDAKALQEKAAKKAAQAAGAAASGGA

SEQ ID NO: 7218 - protein, 71 aa, Unknown
  Sequence found in Organisms: Brassica napus, Brassica juncea, Brassica oleracea, Brassica rapa
MTRGSQRERDRERAAARAGGKGKNADDGLTPEQRRERDGKALQEKAAKKAAQAAAAAGSGGGAGGKGTAKK

SEQ ID NO: 7219 - protein, 71 aa, Brassica napus
MTRGSQRERDRERAAARAGGKGKGADDGLTPEQRRERDGKALQEKAAKKAAQAAAAAGSGGGAGGKGTAKK

SEQ ID NO: 7220 - protein, 71 aa, Raphanus sativus
MTRGSQRERDRERAAARAGGKGKSADDGLTPEQRRERDGKALQEKAAKKAAQAAAAAGSGGGAGGKGTAKK

SEQ ID NO: 7221 - protein, 71 aa, Arabidopsis thaliana
MTRGSQRERDRERAAARAGGKGKNGDDGLTPEQRRERDGKALQEKAAKKAAQAAGASSGGAAGGKGAAAKK

SEQ ID NO: 7222 - protein, 67 aa, Cleome spinosa
MTRGNQRDRDRERAQARTSGKGKTKDDGLTPEQRRERDAKALQEKTAKKAAQAAAASGGGGGGKGNN

SEQ ID NO: 7223 - protein, 66 aa, Orobanche aegyptiaca
MTRGSQRERDRERAQTRTGGKGKGKDDGLTPEQRRERDAKALQEKTAKKAQQAAGGSDGGGKSNKK

SEQ ID NO: 7224 - protein, 65 aa, Jatropha curcas
RGNQRERDRERAQARAPGKGKGKDDGLTPEQRRERDAKALQEKAAKKAAHAAGAGQSGGKGNNDK

SEQ ID NO: 7225 - protein, 67 aa, Lactuca sativa
MTRGNQREKDRERANARNGGKGKTKDDGLTPEQRRERDAKALQEKAAKKAAQAAGSGGDAGGKNTKK

SEQ ID NO: 7226 - protein, 68 aa, Raphanus sativus
MTRGSQRERDRERAAARAGGKGKNADDGLTPEQRRERDGKALQEKAAKKAAQAAAAAASGGSKGTAKK

SEQ ID NO: 7227 - protein, 66 aa, Carthamus tinctorius
MTRGNQREKDRERANARNGGKGKTKDDGLTPEQRRERDAKALQEKAAKKAAQAAGSGDAGGKNTKK

SEQ ID NO: 7228 - protein, 65 aa, Camellia sinensis
MTRGNQRERDRERAQARNGGKGKGKDDGLTPEQRRERDAKALQEKAAKKAAGAAGNAGGKSNNKK

SEQ ID NO: 7229 - protein, 128 aa, Citrus sinensis
MTGEAVNPKAYPLADSNLTITILDLVQQAANYKQLKKGANEATKTLNRGISEFIVMAADTEPLEILLHLPLLAEDKNVPYVFVPSKQALGRACGVTRPVIACSVTSNEASQLKTQIQQLKDAIEKLLI

SEQ ID NO: 7230 - protein, 69 aa, Manihot esculenta
MTRGNQRERDRERAQARTGKGPKSKDDGLTPEQRRERDAKALQEKAAKKSAQAAAGGETSGGKGKNVKK

SEQ ID NO: 7231 - protein, 70 aa, Thellungiella halophila
MTRGSQRERDRERAAARAGGKGKNADDGLTPEQRRERDGKALQEKAAKKAAQAAAASSGGGAGGKGTAKK

SEQ ID NO: 7232 - protein, 66 aa, Ocimum basilicum
MTRGNQREKDRERAQARNSGKGKNKDDGLTPEQRRERDAKALQEKAAKKAAQAAGGSDAGGKSNKK

SEQ ID NO: 7233 - protein, 66 aa, Centaurea maculosa
MTRGNQREKDRERANARNGGKGKTKDDGLTPEQRRERDAKALQEKTAKKAAQAAGSGDAGGKNTKK

SEQ ID NO: 7234 - protein, 67 aa, Lactuca sativa
MTRGNQREKDRERANARNGDKGKTKDDGLTPEQRRERDAKALQEKAAKKAAQAAGSGGDAGGKNTKK

SEQ ID NO: 7235 - protein, 67 aa, Actinidia deliciosa
MTRGNQREKDRERAQARNGGKGKTKDDGLTPEQRRERDAKALQEKAAKKAAQAAGAGEAVRKSNSKK

SEQ ID NO: 7236 - protein, 67 aa, Lactuca sativa
MTRGNQREKDRERANARNGGKGKTKDDGLTPEQRRERDAKALQEKAAKKAAQAAGSGGDAGAKNSKK

SEQ ID NO: 7237 - protein, 68 aa, Populus trichocarpa
MARGNQREKDRERAQARNGGKGKNKDDGLTPEQRRERDAKALQEKTAKKAAQAAGGESSGGDKGNNKK

SEQ ID NO: 7238 - protein, 69 aa, Populus trichocarpa
MTRGNQREKDRERAQARGGNKVNKGKDDGLTHEQRRERDAKALQEKAAKKAAQAAGGESSGGGKGNNKK

SEQ ID NO: 7239 - protein, 84 aa, Manihot esculenta
SNSHSLSFSCSSTLKMTRGNQRERDRERAQARTGKGPKSKDDGLTPEQRRERDAKALQEKAAKKSAQAAAGGETSGGKGKNVKK

SEQ ID NO: 7240 - protein, 64 aa, Cleome gynandra
MTRGNQRERDRERAQARSSGKGKNKDDGLTPEQRRERDAKALQEKAAKKAAQADAGGSKGNNKK

SEQ ID NO: 7241 - protein, 68 aa, Cleome spinosa
MTRGNQRERDRERSQARTSGKGKNKDDGLTPEQRRERDAKALQEKMAKKAAQADAGGNSGGGKGNNKK

SEQ ID NO: 7242 - protein, 68 aa, Cucumis melo
MTRGNQREKDRERAQARNGGKGKTKDDGLTPEQRRERDAKALQEKAAKKAAQAASGGNSSGGKASTKK

SEQ ID NO: 7243 - protein, 66 aa, Antirrhinum majus
MTRGNQREKDRERAQARTGGKGKGKDDGLTPEQRRERDAKALQEKTAKKAAQAGGSADSGGKSNKK

SEQ ID NO: 7244 - protein, 66 aa, Gerbera hybrid cultivar
MTRGNQREKDRERANARNGGKGKTKDDGLTPEQRRERDAKALQEKAAKKAAQAAGGGDAGGKSTKK

SEQ ID NO: 7245 - protein, 336 aa, Brassica napus
MGVDYYNVLQVDRNASDNDLKKAYRKLAMKWHPDKNPNNKKDAEAKFKQISEAYEVLSDPQKKAVYDQYGEEGLKGNVPPPDAGGATYFSTGDGPTSFRFNPRNADDIFAEFFGFSRPFGGGGGGGTRFSSSMFGDNIFASFGEGGGGAMHHGGGARKAAPIENRLPCSLEDLYKGTTKKMKISREIADVSGKTMPVEEILTIDVKPGWKKGTRITFPEKGNEQPGVTPADLVFIIDEKRHPVFTREGNDLIVTQRISLAEALTGYTVNLTTLDGRRLTIPVTNVIHPEYEEVVPKEGMPLQKDQTKRGNLRIKFNIKFPTRLTSEQKAGVKKLLG

SEQ ID NO: 7246 - protein, 348 aa, Arabidopsis thaliana
MGVDYYKVLQVDRSANDDDLKKAYRKLAMKWHPDKNPNNKKDAEAKFKQISEAYDVLSDPQKRAVYDQYGEEGLKGNVPPPNAATSGASYFSTGDGSSSFRFNPRSADDIFAEFFGFSTPFGGGGGGTGGQRFASRMFGDDMYASFGEGAGGGGAMHHHHHHHHHAAARKVAPIENKLPCSLEDLYKGTTKKMKISREIVDVSGKAMQVEEILTIGVKPGWKKGTKITFPEKGNEHPGVIPADLVFIIDEKPHPVFTREGNDLIVTQKVSLADALTGYTANIATLDGRTLTIPITNVIHPEYEEVVPKEGMPLQKDQTKKGNLRIKFNIKFPARLTAEQKAGFKKLIG

SEQ ID NO: 7247 - protein, 344 aa, Citrus sinensis
  misc_feature (119)..(119): Xaa can be any naturally occurring amino acid
MGVDYYKILGVDRNAKDDDLKKAYRKLAMKWHPDKNPNNKKDAETKFKQISEAYEVLSDPQKRAVYDQYGEEGLKGQMPPPDAGGPGGASFFSTGEGPTSFRFNPRSADDIFAEFFGFXHPFGGMGGGGGGMRGSRFAGGLFGDDMFGPFGEGGGGSMGGGGARKAPPIENKLPCSLEDLYKGTTKKMKISREIADISGKTMQVEEILTIDVKPGWKKGTKITFPEKGNEQPNVIPADLVFVIDEKPHSVFTRDGNDLIVTQKISLAEALTGYTVHLTTLDGRSLNIPINNVIHPTYEEIVPREGMPLQKDPSKRGNLRIKFNIRFPTRLTAEQKAGIKKLLGP

SEQ ID NO: 7248 - protein, 344 aa, Euphorbia esula
MGVDYYKILQVERGAKDDDLKKAYRKLAMKWHPDKNPNNKKDAEAKFKQISEAYEVLSDPQKRAVYDQYGEEGLKGQFQPPPDTSGSNYYSTGEIPTSFRFNPRSADDIFAEFFGHSSPFGGMGGGGGGMRGTRFSSGIFGDDVFASFGEGGGGGSMHHASGPRKASPIENRLSCSLEDLYKGTTKKMKISREIVDISGKTMQVEEILTIDVKPGWKKGTKITFPEKGNEQPNVIPADLVFIIDEKPHPVFTRDGNDLVVTQKISLAEALTGYTVHLTALDGRSLSIPINSVINPNYEEIVPREGMPIQKDPTKRGNLRIKFNIKFPTRLTSEQKAGIKKLLGS

SEQ ID NO: 7249 - protein, 341 aa, Manihot esculenta
MGVDYYKILQVDRNAKDDDLKKAYRKLAMKWHPDKNPNNKKESEAKFKQISEAYEVLTDPQKRVVYDQYGEEGLKGSVPPPDTGGTSYYSTGEIPTSFRFNPRNADDIFAEFFGFSRPFGGMGGAGGGMRGTRFSSGIFGDDMFGSFGDGGGGSMHQSGPRKAPAIENKLPCRLEELYKGTTKKMKISREIVDISGKTMQVQEILTIDIKPGWKKGTKITFPEKGNEQPNVVPADLVFIIDEKPHPMFTRDGSDLIVTQNISLAEALTGYTVHLTTLDGRNLSIPISSVIHPNYEEVIPREGMPIQKDPTKRGNLRIKFNIKFPTRLTSEQKAGIKKLLGS

SEQ ID NO: 7250 - protein, 345 aa, Vigna unguiculata
MGVDYYKILQVDKNAKDDDLKKAYRKLAMKWHPDKNPNNKKEAEAKFKQISEAYEVLSDPQKKAIYDQYGEEGLKGQVPPPDAGGAGTTYFSTGDMPGSFRFNPRNADDIFAEFFGFSSPFGGMGGRGGGGGGGMRSRFPGGMFGDDMFASFGDGAVHMSQGAPRKAPPIENKLPCTLEEIYRGTTKKMKISREIADASGKTMPVEEILTINVKPGWKKGTKITFPEKGNEQPNVTPADLVFIIDEKPHSVFTRDGNDLVVTQKISLAEALTGYTVHLTTLDGRNLTIPISNVIHPSYEEVVPREGMPLPKDPSKRGNLRIKFNIKFPTRLSDEQKAGIKKFLAA

SEQ ID NO: 7251 - protein, 678 aa, Arabidopsis thaliana
MDMESWKLLRSVCVLSFLLGSCFVYQSLRVVDAQEDPKPAVTLQVDASNGGGRPIPETLFGIFFEEINHAGAGGLWAELVSNRGFEAGGQNTPSNIWPWSIVGDHSSIYVATDRSSCFERNKIALRMDVLCDSKGCPSGGVGVYNPGYWGMNIEEGKKYKVALYVRSTGDIDLSVSLTSSNGSRTLASEKIIASASDVSKWIKKEVLLEAKATDPSARLQLTTTKKGSIWIDQVSAMPVDTHKGHGFRNDLFQMMADIKPRFIRFPGGCFVEGEWLSNAFRWKETVGPWEERPGHFGDVWKYWTDDGLGHFEFFQMAEDIGAAPIWVFNNGISHNDEVETASIMPFVQEALDGIEFARGDANSTWGSVRAKMGRQEPFELKYVAIGNEDCGKTYYRGNYIVFYDAIKKAYPDIKIISNCDGSSHPLDHPADYYDYHIYTSASNLFSMYHQFDRTSRKGPKAFVSEYAVTGKDAGTGSLLASLAEAAFLIGLEKNSDIVEMASYAPLFVNTNDRRWNPDAIVFNSSHLYGTPSYWVQRFFAESSGATLLTSTLKGNSTSLVASAISWKNNGKDYIRIKAVNFGANSENMQVLVTGLDPNVMRVSGSKKTVLTSTNVMDENSFSQPEKVVPHESLLELAEEDMTVVLPPHSFSSFDLLKESAKIRMPISDSSSHQKTTTV

SEQ ID NO: 7252 - protein, 678 aa, Arabidopsis lyrata
MDMESWKLLRSVCLLSFLLGSCFVYQSLRVVDAQEDPKPAVTLQVDASNGAGRPIPDTLFGIFFEEINHAGAGGLWAELVSNRGFEAGGQNTPSNIWPWSIVGDHSSIYVATDRSSCFERNKIALRMDVLCDSKDCPSGGVGVYNPGYWGMNIEEGKKYKVALYVRSTGDIDVSVSLTSSNGSLTLASEKIIASASDVSKWIKKEVLLEAKSTDPSARLQLTTTKKGSIWIDQVSAMPVDTYKGHGFRNDLFQMMVDIKPRFIRFPGGCFVEGEWLSNAFRWKETVGPWEERPGHFGDVWKYWTDDGLGHFEFFQMAEDIGAAPIWVFNNGISHNDEVETASIMPFVQEALDGIEFARGDANSTWGSVRAKMGRQEPFELKYVAIGNEDCGKTYYRGNYIVFYNAIKKAYPDIKIISNCDGSSHPLDHPADYYDYHIYTSASNLFSMYHQFDRTSRSGPKAFVSEYAVTGKDAGTGSLLASLAEAAFLIGLEKNSDIVEMASYAPLFVNTNDRRWNPDAIVFNSSHLYGTPSYWVQRFFAESSGATLLTSTLKGNSTSLVASAISWENNGKDYIRIKAVNFGANSVNMKVLVTGLDPNVMRVTGSKKTVLTSTNVMDENSFSQPEKVVPHESLLEMAEEDMTVVLPPHSFSSFDLLKESAKIKMPISDSSSHQKTTTV

SEQ ID NO: 7253 - protein, 676 aa, Arabidopsis thaliana
MESWKLLRSVCVLSFLLGSCFVYQSLRVVDAQEDPKPAVTLQVDASNGGGRPIPETLFGIFFEEINHAGAGGLWAELVSNRGFEAGGQNTPSNIWPWSIVGDHSSIYVATDRSSCFERNKIALRMDVLCDSKGCPSGGVGVYNPGYWGMNIEEGKKYKVALYVRSTGDIDLSVSLTSSNGSRTLASEKIIASASDVSKWIKKEVLLEAKATDPSARLQLTTTKKGSIWIDQVSAMPVDTHKGHGFRNDLFQMMADIKPRFIRFPGGCFVEGEWLSNAFRWKETVGPWEERPGHFGDVWKYWTDDGLGHFEFFQMAEDIGAAPIWVFNNGISHNDEVETASIMPFVQEALDGIEFARGDANSTWGSVRAKMGRQEPFELKYVAIGNEDCGKTYYRGNYIVFYDAIKKAYPDIKIISNCDGSSHPLDHPADYYDYHIYTSASNLFSMYHQFDRTSRKGPKAFVSEYAVTGKDAGTGSLLASLAEAAFLIGLEKNSDIVEMASYAPLFVNTNDRRWNPDAIVFNSSHLYGTPSYWVQRFFAESSGATLLTSTLKGNSTSLVASAISWKNNGKDYIRIKAVNFGANSENMQVLVTGLDPNVMRVSGSKKTVLTSTNVMDENSFSQPEKVVPHESLLELAEEDMTVVLPPHSFSSFDLLKESAKIRMPISDSSSHQKTTTV

SEQ ID NO: 7254 - protein, 458 aa, Arabidopsis lyrata
MQMKLLLTVSIILNLVFTVHILYYSSTTWNPTWTTRAAAEAETVASFSCSGHGRAFVDGLGVLDGQKPSCECNNCYTGKDCSVLLKDCPVDANSGDPLFLEPFWMRQAESSAVLVSGWHRMSYIYQDGTYVSRELEKVIRKLHSVVGNAVTDNRFVIFGSGTTQLLAAAVHVLSLTNSSISSPARLLTSIPYYSMYKDQAEFFDSAHLKFEGDVSAWKQSGRNDNITQVIEVVTSPNNPDGKLKRAVLDGPNVKIVHDYAYYWPYFTPITHPVDENLSLFSLSKATGHAGSRFGWGLVKDKSIYEKMDRYIRLTSMGVSKETQLHVLQLLKVVVGDRGDDIFNFGYGTLKKRWEILNKILSISTRFSLQAINPEYCNYFKKVREFTPSYAWVKCERPEDTNCYEIFRAAKITGRNGNVFGSEERFVRLSLIRSQDDFDQLIDMLKKLVSEEAVGADSI

SEQ ID NO: 7255 - protein, 269 aa, Brassica rapa
  misc_feature (209)..(209): Xaa can be any naturally occurring amino acid
MGDLYALDFDGVLCDSCGESSLSAVKAARVRWPGLFVGVDSALEEWIVDQMHIVRPVVETGYENLLLVRLLLETKMPSIRKSSVAEGLTVDGILESWGKIKPVIMEAWDEDDKDALIDLFGSVRDDWINNDLTTWIGANRFYPGVSDALKFASSKIYIVTTKQGRFAEALLREIAGVIIPPERIYALGSGPKVEVLKLLQNKPEHQGLXLHFVEDRLATLKNVIKEPELDKWNLYLSNWGYNTEKERAEAESIPRIQVIELSTFSNKLK

SEQ ID NO: 7256 - protein, 269 aa, Brassica napus
MGDLYALDFDGVLCDSCGESSLSAVKAARVRWPGLFVGVDSALEEWIVDQMHIVRPVVETGYENLLLVRLLLETKMPSIRKSSVAEGLTVDGILESWGKIKPVIMEAWDEDDKDALIDLFGKVRDDWINNDLTTWIGANRFYPGVSDALKFASSKIYIVTTKQGRFAEALLREIAGVIIPPERIYALGSGPKVEVLKLLQNKPEHQGLKLHFVEDRLATLKNVIKKPELDKWNLYLSNWGYNTEKERAEAESIPRIQVIELSTFSNKLK

SEQ ID NO: 7257 - protein, 269 aa, Raphanus sativus
MGDLYALDFDGVLCDSCGESSLSAVKAARARWPGLFQGVDSALEEWIVDQMHIVRPVVETGYENLLLVRLLLETKMPSIRKSSVAEGLTVDGILESWGKIKPVIMEAWGEEDKEALIDLFGKVRDDWINNDLTTWIGANRFYPGVSDALKFASSKIYIVTTKQGRFAEALLREIAGVIIPPERIYGLGTGPKVEVLKLLQNKPEHQGLKLHFVEDRLATLKNVIKEPELDKWNLYLSNWGYNTEKERAEAESIPRIQVIELSTFSNKLK

SEQ ID NO: 7258 - protein, 268 aa, Arabidopsis lyrata
MGDLYALDFDGVLCDSCGESSLSAVKAAKVRWPDLFEGVDSALEEWIVDQMHIVRPVVETGYENLLLVRLLLETRIPSIRKSSVAEGLTVDGILESWAKIKPVIMEAWDEDKDALIDLFGKVRDDWINKDLTTWIGANRFYPGVSDALKFASSKIYIVTTKQGRFAEALLREIAGVIIPSERIYGLGSGPKVEVLKLIQDKPEHQGLTLHFVEDRLATLKNVIKEPELDKWNLYLGNWGYNTEKERAEAASIPRIQVIELSTFSNKLK

SEQ ID NO: 7259 - protein, 257 aa, Brassica napus
MGDLYALDFDGVLCDSCGESSLSAVKAARVRWPGLFVGVDSALEEWIVDQMHIVRPVVETGYENLLLVRLLLETKMPSIRKSSVAEGLTVDEILESWGKIKPVIMEAWDEDDKDALIDLFGKVRDDWINNDLTTWIGANRFYPGVSDALKFASSKIYIVTTKQGRFAEALLREIAGVIIPPERIYALGSGPKVEVLKLLQNKPEHQGLKLHFVEDRLATLKNVIKEPELDKWNLYLSNWGYNTEKERAEAESIPGFR

SEQ ID NO: 7260 - protein, 268 aa, Arabidopsis thaliana
MGDLYALDFDGVLCDSCGESSLSAVKAAKVRWPDLFEGVDSALEEWIVDQMHIVRPVVETGYENLLLVRLLLETKIPSIRKSSVAEGLTVDGILESWAKFKPVIMEAWDEDRDALVDLFGKVRDDWINKDLTTWIGANRFYPGVSDALKFASSKIYIVTTKQGRFAEALLREIAGVIIPSERIYGLGSGPKVEVLKLLQDKPEHQGLTLHFVEDRLATLKNVIKEPELDKWSLYLGTWGYNTEKERAEAAGIPRIQVIELSTFSNKLK

SEQ ID NO: 7261 - protein, 268 aa, Cleome spinosa
MGDLYALDFDGVLCDSCGESSLSAVKAAKVRWPGLFDGVDSALEEWIVDQMHIVRPVVETGYENLLLVRLLLESRMPSIRKSSVAEGLTVDVILESWSKIKPVIMEAWNEDRDALVDLFGKVRDEWMDKDLTTWMGANRFYPGVSDALRFASSRVYIVTTKQSRFADALLRELAGVTIPSERIYGLGTGPKVEVLKLLQNKPEHQGLTLHFVEDRLATLKNVIKEPELNKWNLYLGNWGYNTEKERAEAAGIPRIQVIELSTFSSKLK

SEQ ID NO: 7262 - protein, 255 aa, Thellungiella halophila
MGDLYALDFDGVLCDSCGESSLSAVKAARVRWPGLFEGVDSALEEWIVDQMHIVRPVVETGYENLLLVRLLLETKIPSIRKSSVAEGLTVDGILEGWGKIKPVIMEAWDEDKDALVDLFGKVRDDWINKDLTTWIGANRFYPGVSDALKFASSKIYIVTTKQGRFAEALLREIAGVTLPSERVYGLGTGPKVEVLKLLQNKPEHQGLKLHFVEDRLATLKNVIKEPQLDNWNLYLGCLLSLAHIISSGSPCYMVI

SEQ ID NO: 7263 - protein, 268 aa, Ricinus communis
MGDLYALDFDGVLCDSCGESSLSAVKAAKVRWPGLFDGVDSALEEWIVDQMFIVRPVVETGYENLLLVRLLLEMRMPSIRKSSVAEGLTVEGILENWSKLKPVIMEEWGEDRDSLIHLFGKIRDEWMDKDLATWIAANRFYPGVPDALKFASSRIYIVTTKQSRFADALLRELAGLTIPPEKIYGLGTGPKVKVLKQLQEKPEYQGLTLHFVEDRLATLKNVIKEPELDGWNLYLGDWGYNTQKEREEAASIPRIRLLQLSDFSKKLK

SEQ ID NO: 7264 - protein, 268 aa, Citrus sinensis
MADLYALDFDGVLCDSCGESSLSAVKAAKVRWPGLFDGVDSVIEDWIVDQMHILRPVVETGYENLLLVRLLLEIRMPSIRKSSVSEGLTVEGILENWSKIKPVIMEDWSENRDALVDLFGKVRDEWMDKDLTTWIGANRFYPGIPDALKFASSRIYIVTTKQSRFADALLRELAGVTIPPDRIYGLGTGPKVEVLKQLQKKPELQGMTLHFVEDRLATLKNVIKEPELDGWNLYLGDWGYNTQKEREEAASIPRIQLLQLSDFSRKLK

SEQ ID NO: 7265 - protein, 268 aa, Prunus persica
MGDLYALDFDGVLCDSCGESSLSAVKAAKVRWPSLFNGVDSTLEDWVVEQMHIVRPVVETGYENLLLVRLLLEARIPSIRKSSVAEGITVEGILEKWSELKPVIMEEWGEERDALINLFGKVRDEWMDEGLTTWIGANRLYPGVPDALKFASSTIYIVTTKQSRFADALLRELAGVTIPPERIFGLGSGPKVEVLKQLQKKPEHQGLKLHFVEDRLATLKNVIKEPELDGWNLYLGDWGYNTQKEREEAATIPRIRILELSDFSNKLK

SEQ ID NO: 7266 - protein, 268 aa, Prunus persica
MGDLYALDFDGVLCDSCGESSLSAVKAAKVRWPSLFNGVDSTLEDWVVEQMHIVRPVVETGYENLLLVRLLLEARIPSIRKSSVAEGITVEGILEKWSELKPVIMEEWGEERDALINLFGKVRDEWMDEGLTTWIGANRLYPGVPDALKFASSTIYIVTTKQSRFADALLRELAGVTIPPERIFGLGSGPKVEVLKQLQKKPDHQGLKLHFVEDRLATLKNVIKEPELDGWNLYLGDWGYNTQKEREEAATIPRIRILELSDFSKKLK

SEQ ID NO: 7267 - protein, 270 aa, Tropaeolum majus
MGEDLYALDFDGVLCDSCGESSLSAVKAAKIRWPGLFDGVDLTMEDWIVDQMHIVRPVVETGYENLLLVRLLVEMRIPSIRKSLAAEGLTVDGILDNWSNLKPIIMEAWSEDKDALINLFGKVRDEWIDKDLATWIGANRFYPGVPDALRFASSRIYIVTTKQGRFAEALLRELAGVTISPERIYGLGTGPKVEVLKQLQNKPEHQGATLHFVEDRLATLKNVIKDSELDGWNLYLGNWGYNTQKERDEATGIPRIQVLELSDFSKSSSS

SEQ ID NO: 7268 - protein, 272 aa, Unknown
  Sequence found in Organisms: Brassica napus, Zea mays
MTTIINSGGAIAIREVWAENLESEFELISGIIDDYPFVSMDTEFPGVIFKSDLRRGNPADLYRLLKSNVDALSLIQVGLTLSDADGNLPDLGDGRRFIWEFNFKDFDVARDAHAPDSIELLRRQGIDFERNRRDGVDSERFAELMMSSGLVCNEEVSWVTFHSAYDFAYLMKILTRRELPCALGEFQRVMRALFGERVYDMKHMMRFCERKLYGGLDRVARTLEVNREVGKCHQAGSDSLLTWHAFQRMRDLYFLQDGPEKHAGVLYGLEVF

SEQ ID NO: 7269 - protein, 271 aa, Brassica rapa
MTIINLGGAIAIREVWAENLESEFEVISGIIDDYPFVSMDTEFPGVIFKSDLRRGNPADLYRLLKSNVDALSLIQVGLTLSDADGNLPDLGDGRRFIWEFNFKDFDVARDAHAPDSIELLRRQGIDFERNRRDGVDSERFAELMMSSGLVCNEEVSWVTFHSAYDFAYLMKILTRRELPCALGEFQRVMRALFGERVYDMKHMMRFCERKLYGGLDRVARTLEVNREVGKCHQAGSDSLLTWHAFQKMRDLYFHQDGPEKHAGVLYGLEVF

SEQ ID NO: 7270 - protein, 275 aa, Thellungiella halophila
MTIIKPRGAVVIREVWAENLESEIELISGIVDDYPFVSMDTEFPGVIFKSDLRRGNPDDLYRLLKSNVDALSLIQVGLTLSDADGNLPDLDGCGGGGNRFIWEFNFKDFDVARDAHAPDSIELLRRQGIDFERNRRDGVESERFAELMMSSGLVCNEGVSWVSFHSAYDFGYLMKILTRRELPCALGGFQRVMRALFGERVYDVKHVMRFCERRLYGGLDRVARTLEVNRAVGKCHQAGSDSLLTWHAFQRMRDLYFLQDGPEKHAGVLYGLEVF

SEQ ID NO: 7271 - protein, 280 aa, Arabidopsis lyrata
MAIIKSNTYNKPCGGITVVTREVWAENLESEFELISEIIDDFPFISMDTEFPGVIFKSDLRFTNPADLYSLLKANVDALSLIQVGLTLSDANGNLPDLGENHRGFIWEFNFRDFDVARDAHAPDSIELLRRQGIDFERNCRDGVDSERFAELMMSSGLVCNEDVSWVTFHSAYDFGYLMKILTRRELPSALGEFKRVMRVLFGERVYDVKHIMKFCERRLYGGLDRVARTLEVNRAVGKCHQAGSDSLLTWHAFQRMRDLYFVQDGPEKHAGVLYGLEVF

SEQ ID NO: 7272 - protein, 280 aa, Arabidopsis thaliana
MAIIKPNRDLKPDGVTVVTREVWAENLESEFELISEIIDDYPFISMDTEFPGVIFKSDLRFTNPDDLYTLLKANVDALSLIQVGLTLSDVNGNLPDLGDDLHRGFIWEFNFRDFDVARDAHAPDSIELLRRQGIDFERNCRDGVESERFAELMMSSGLVCNEEVSWVTFHSAYDFGYLMKILTRRELPGALGEFKRVMRVLFGERVYDVKHMMKFCERRLFGGLDRVARTLEVNRAVGKCHQAGSDSLLTWHAFQRMRDLYFVQDGPEKHAGVLYGLEVF

SEQ ID NO: 7273 - protein, 274 aa, Arabidopsis lyrata
MINSDVGIVIRDVWADNLESEFELISGIVEAYPFISMDTEFPGVIFKADLAVLRLGNPNYLYNLLKSNVDALSLIQVGLTLSDADGNLPDLGVQNRRFIWEFNFRDFDVERDPHAPDSIELLRRHGIDFERNRREGVKSGRFAELMMSSGLICNESVSWVTFHSAYDFGYLVKILTRRELPVALREFLRLLRAFFGERVYDVKHIMRFCEQRRLYGGLDRVARSLEVNRAVGKCHQAGSDSLLTWQAFQRMRDLYFVEDGAEKHAGVLYGLEVF

SEQ ID NO: 7274 - protein, 282 aa, Brassica napus
HASGRRDFESITMINPSVVVREVWADNLESEFELISGIVEDYPFISMDTEFPGVIYKADLRRINPGYLYKLLKSNVDALSLIQVGLTLSDADGNLPHLGGGVGGSRFIWEFNFRDFDVDRDPHAPDSIELLRRHGIDFERNRREGVESGRFAELMVSSGLICNESVSWVTFHSAYDFGYLVKILTRRELPGSLGEFLRLFRAFFGERVYDVKHMMRFCERRLFGGLDRVARSLEVNREVGKCHQAGSDSLLTWQAFRRMRDLYFVEDGPEKHAGVLYGLEVF

SEQ ID NO: 7275 - protein, 270 aa, Brassica napus
MINPSVVVREVWADNLESEFELISGIVEDYPFISMDTEFPGVIYKADLRRINPGYLYKLLKSNVDALSLIQVGLTLSDADGNLPHLGGGVGGSRFIWEFNFRDFDVDRDPHAPDSIELLRRHGIDFERNRREGVESGRFAELMVSSGLICNESVSWVTFHSAYDFGYLVKILTRRELPGSLGEFLRLFRAFFGERVYDVKHMMRFCERRLFGGLDRVARSLEVNREVGKCHQAGSDSLLTWQAFRRMRDLYFVEDGPEKHAGVLYGLEVF

SEQ ID NO: 7276 - protein, 270 aa, Brassica napus
MITPSVVVREVWADNLESEFELISGIVEDYPFISMDTEFPGVIYKADLRRLNPGYLYKLLKSNVDALSLIQVGLTLSDADGNLPDLGGGGGGSRFIWELNFRDFDVDRDPHAPDSIELLRRHGIDFERNRREGVESGRFAELMVSSGLICNESVSWVTFHSAYDFGYLVKILTRRELPGSLGEFLRLLRAFFGERVYDVKHMMRFCERRLFGGLDRVARSLEVNREVGKCHQAGSDSLLTWQAFRRMRDLYFVEDGPEKHAGVLYGLEVF

SEQ ID NO: 7277 - protein, 270 aa, Brassica juncea
MSSSISWAPWAAPFDLPPPFLGPLSSPPPPPPEAFTLSPPPSSFLPPPFFSPPFSLLPFLKKPRRPPPLLASAFPVLPPPPLFAFSSFPILPSPIPFICTGISNPPPSATTGFETIHHHHNLIRSLSSTTITHLRHLVRHHHHLIRRHASSTSMTMTSSFIIIFIILIELIVIIIIFTELITKLIVILLTKLIVFLLFLKLNRLLLILRRHRRHHHLHILPTTTVSSLHHHDLLNLLRSQLHWLTTATTISFPVALFSTAATAYDLGVFP

SEQ ID NO: 7278 - protein, 265 aa, Arabidopsis lyrata
MARVVESDSSSGCSNVLSLDSIRESLIRQEDTIVFSLIERAKFPLNAPAFEESRCLDSGNSSSLTEFFVREIETIQAKVGRYENPEENPFFLENIPHAVFPTHKYPPALHPKALSVNINKHIWDIYFKELLPLFVKPGDDGNYPSTAASDLACLQALSRRIHYGKFVAEVKFRDAPQDYERAIRAQDREALMKLLTFEKVEEMVKKRVQKKAETFGQEVKCITDSGDESKKKYKVDPLLVSRIYGEWLIPLTKLVEVEYLLRRLD

SEQ ID NO: 7279 - protein, 262 aa, Thellungiella halophila
MERVVESDSGSGESDVVLSLDSIRESLIRQEDTIVFSFIERAKFPLNSPAFEDSRCLHSGNSSSLTEFFVREIEIIQAKVGRYENPEENPFFLDNIPPSVFPTRKYPPALHPKALSVNINQRIWDIYFKELLPLFVKPGDDGNYVSTAASDLACLQALSRRIHYGKFVAEVKFRDAPQDYEPAIRAKDTEALMKLLTFEKVEEMVKKRVQKKAETFGQDVKCISGDDKSYKVDPLIVSRIYGEWLIPLTKLVEVEYLLRRLD

SEQ ID NO: 7280 - protein, 259 aa, Raphanus sativus
  misc_feature (36)..(36): Xaa can be any naturally occurring amino acid
  misc_feature (69)..(69): Xaa can be any naturally occurring amino acid
  misc_feature (116)..(116): Xaa can be any naturally occurring amino acid
MANVVESDTVSGGSEVQQLSLDSIRESLIRQEDTIXFSLIERAKFPLNSPAFEDSSSLTEFFVREIETXQAKVGRYENPEENPFFLDNIPRSVFPTHKYPQVLHPKASSVNINKRXWDVYLKELLPLFVKPGDDGNYASTAASDLACLQALSRRIHYGKFVAEVKFRDAPHDYEPAIRSKDTEALMKLLTFEEVEEMVKKRVEKKAETFGQEVKCVSGGDESEKTKYKVDPTLVSRIYGEWLIPLTKDVEVEYLLRRLD

SEQ ID NO: 7281 - protein, 259 aa, Raphanus sativus
  misc_feature (78)..(78): Xaa can be any naturally occurring amino acid
  misc_feature (89)..(89): Xaa can be any naturally occurring amino acid
  misc_feature (100)..(100): Xaa can be any naturally occurring amino acid
  misc_feature (150)..(150): Xaa can be any naturally occurring amino acid
  misc_feature (165)..(165): Xaa can be any naturally occurring amino acid
  misc_feature (170)..(170): Xaa can be any naturally occurring amino acid
MARVVESDTVSGGSDVLQLSLDSIRESLIRQEDTIVFSLIERAKFPLNSPAFEDSSSSLTEFFVREIETIQAKVGRYXNPEENPFFLDXIPHSVFPTHKXPQVLHPKASSVNINKRLWDVYFKELLPLFVKPGDDGNYASTAASDLACLXALSRRIHYGKFVAEXKFRDXPHDYEPAIRSKDTEALMKLLTFEKVEEMVKRVEKKAETFGQEVKCVSGGDESEKKKYKVDPYLVSRIYGEWLIPLTKDVEVEYLLRRLD

SEQ ID NO: 7282 - protein, 257 aa, Raphanus sativus
  misc_feature (62)..(62): Xaa can be any naturally occurring amino acid
  misc_feature (220)..(220): Xaa can be any naturally occurring amino acid
  misc_feature (223)..(223): Xaa can be any naturally occurring amino acid
  misc_feature (230)..(230): Xaa can be any naturally occurring amino acid
MARVVESDTVPGGSDVLQLSLDSIRESLIRQEDTIVFSLIERAKFPLNSAENSSSLTEFFVXEIETIQAKVGRYENPEENPFFLDNIPHSVFPTPKYPPVLYPKASSVNINKRLWDVYFKELLPLFVKPGDDGNYASTAASDLACLQALSRRIHYGKFVAEVKFRDAPHDYEPAIRSKDTEALMKLLTFEKVEEMVKKRVEKKAETFGQEVKCVSGGDEXEKXKYKVDPXLVSRIYGEWLIPLTKDVEVEYLLRRLD

SEQ ID NO: 7283 - protein, 259 aa, Brassica napus
MSSVVVESDVQLSLDSIRESLIRQEDTIVFSLIERAKFPLNSLAFEESSCLDSGNSSSLTEFFVREIETIQAKVGRYDNPEENPFFLDNIPQSVFPTHKYPQALYPKASSVNINKRLWDVYFKELLPSFVKPGDDGNYASTAASDLACLQAISRRIHYGKFVAEVKFSDAPHDYEPAICSKDTEALMKLLTFEKVEEMVKKRVEKKAETFGQEVKCVSGDDESEKNYKVDPSLVSRIYGEWLIPLTKDVEVEYLLRRLD

SEQ ID NO: 7284 - protein, 154 aa, Brassica rapa
MSSVVVESDVQLSLDSIRESLVRQEDTVVFSLIERAKFPLNSPAFEEPRCLDSGNSSSLTEFFVREIETIQAKVGRYDNPEENPFFLDNIPHSIFPTHKYPQVLYPKASSVNINKRLWDVYFKELLPLFVKPGDDGNYASTAASDLACLQDSLR

SEQ ID NO: 7285 - protein, 245 aa, Brassica juncea
  misc_feature (66)..(66): Xaa can be any naturally occurring amino acid
  misc_feature (75)..(75): Xaa can be any naturally occurring amino acid
  misc_feature (138)..(138): Xaa can be any naturally occurring amino acid
  misc_feature (218)..(218): Xaa can be any naturally occurring amino acid
  misc_feature (221)..(221): Xaa can be any naturally occurring amino acid
  misc_feature (234)..(234): Xaa can be any naturally occurring amino acid
MELKVYADRMSQPSRAVIIFCKVNGIEFDEVLIILAKRQQLTPEFKEINPLGKVPTIVDGRLKLFXSHAILIYLXSAFPSVADHWYPNDLSKRAKIHSVLDWHHTNLRPGAAGYVMNTVLAPFLGRSLDSKAAAEAEXILTKSLSTLETFWLKGNAKFLLGSNQPSIADLSLVCELMQLQVLDEKDRLRLFSPYKKVEEWIENTRKATQPHFDLVHKXLYXAKDKFDKQRKMGXTVSKPGFQSKL

SEQ ID NO: 7286 - protein, 241 aa, Brassica napus
MKLKVYADRMSQPSRAVIIFCKVNGIEFDEVLIILAKRQQFSPEFKEINPLGKVPSIVDGRFKLFESHTILIYLASAFPSVADHWYPNDLSKRAKIHSVLDWHHTNLRPGAAGYVMNTVLAPFLGRSLDSKAAAEAEKILTKSLSTLETFWLKGNAKFLLGSNQPSIADLSLVCELMQLQVLDEKDRLRLFSPYKKVEEWIENTRKATQPHFDVVHKTLYGAKDKFDKQRKMSKPGLQSKM

SEQ ID NO: 7287 - protein, 241 aa, Brassica napus
MKLKVYADRMSQPSRAIIIFCKVNGIEFDEVLIILAKRQQLSPEFKEINPLGKVPSIVDGRFKLFESHAILIYLASAFPSVADHWYPNDLSKRAKIHSVLDWHHTNLRPGAAGYVMNTVLAPFLGRSLDSKAAAEAEKILTKSLSTLETFWLKSNAKFLLGSNQPSIADLSLVCELMQLQVLDEKDRLRLFSPSKKVEEWIENTRKATQPHFDVVHKTLYGAKDKFDKQRKMSKPGLQSKM

SEQ ID NO: 7288 - protein, 241 aa, Brassica oleracea
MKLKVYADRMSQPSRAVIILCKVNGIEFDEVLIILAKRQQLSPEFKEINPLGKVPTIVDGRFKLFESHAILIYLASAFPSVADHWYPNDLSKRAKIHSVLDWHHTNLRPGAAGYVMNTVLAPFLGRSLDSKAAAEAEKILTKSLSTLETFWLKGNAKFLLGSSQPSVADLSLVCEIMQLQVLDEKDRLRLFSPYKKVEEWIENTRKATQPHFDVVHKTLYGAKDKFDKQRKMSKPGLQSKM

SEQ ID NO: 7289 - protein, 241 aa, Brassica rapa
MKLKVYADRMSQPSRAIIIFCKVNGIEFDEVLIILAKRQQLSPEFKEINPLGKVPSIVDGRFKLFESHAILIYLASAFPSVADHWYPNDVSKRAKIHSVLDWHHTNLRPGAAGYVMNTVLAPFLGRSLDSKAAAEAEKILTKSLSTLETFWLKGNAKFLLGSNQPSVADLSLVCELMQLQVLDEKDRLRLFSPYKKVEEWIENTRKATQPHFDVVHKTLYGAKDKFDKQRKMSKPGLQSKM

SEQ ID NO: 7290 - protein, 241 aa, Raphanus sativus
MKLKVYADRMSQPSRAVIIFCKVNGIQFDEVLINLAKRQQLSPEFKEINPLGKVPAIVDGRFKLFESHAILIYLASAFPSVADHWYPNDLSKRAKIHSVLDWHHTNLRPGAAGYVMNSVLAPFLGRSLDSKAAAEAEKILTKSLSTLETFWLKGNGKFLLGSNQPSIADLNLVCELMQLQVLDEKDRLRLFSPYKKVEEWIEDTRKATLPHFDVVHKILYGAKDKFDKQLKMSKPGFQSKM

SEQ ID NO: 7291 - protein, 241 aa, Raphanus sativus
  misc_feature (239)..(239): Xaa can be any naturally occurring amino acid
MKLKVYADRMSQPSRAVIIFCKVNGIQFDEVLINLAKRQQLSPDFIEINPLGKVPAIVDGRFKLFESHAILIYLASAFPSVADHWYPNDLSKRAKIHSVLDWHHTNLRPGAAGYVMNSVLAPFLGRSLDSKAAAEAEKLLTKSLSTLETFWLKGNGKFLLGSNQPSIADLNLVCELMQLQILDEKDRLRLFSPYKKVEEWIENTRKATLPHFDVVHKILYGAKDKFDKQLKMSKPGFQXKM

SEQ ID NO: 7292 - protein, 234 aa, Brassica napus
MKLKVYADRMSQPSRAVIILCKVNGIEFDEVLIILAKRQQLSPEFKEINPLGKVPTIVDGRFKLFESHAILIYLASAFPSVADHWYPNDLSKRAKIHSVLDWHHTNLRPGAAGYVMNTVLAPFLGRSLDSKAAAEAEKILTKSLSTLETFWLKGNAKFLLGSSQPSVADLSLVCEIMQLQVLDEKDRLRLFSPYKKVEEWIENTRKATQPHFDVVHKTLYGAKDKLDKQRKMSK

SEQ ID NO: 7293 - protein, 232 aa, Brassica napus
  misc_feature (226)..(226): Xaa can be any naturally occurring amino acid
MKLKVYADRMSQPSRAVIILCKVNGIEFDEVLIILAKRQQLSPEFKEINPLGKVPTIVDGRFKLFESHAILIYLASAFPSVADHWYPNDLSKRAKIHSVLDWHHTNLRPGAAGYVMNTVLAPFLGRSLDSKAAAEAEKILTKSLSTLETFWLKGNAKFLLGSSQPSVADLSLVCEIMQLQVLDEKDRLRLFSPYKKVEEWIENTRKATQPHFDVVHKTLYGAKDKXDKQRKM

SEQ ID NO: 7294 - protein, 244 aa, Arabidopsis lyrata
MKLKVYADRMSQPSRAVIIFCKVNGIQFDEVLISLAKRQQLSPEFKDINPMGKVPAIVDGRLKLFESHAILIYLSSAFPSVADHWYPNDLSKRAKIHSVMDWHHTNLRPGAAGYVLNSVLAPALGLPLNPKAAVEAEKLLTKSLSTLETFWLKGNAKFLLGSNQPSIADLSLVCELMQLQVLDDKDRLRLLSPHKKVEQWIENTRKATMPHFDETHEILFKAKQGFQKQREMGTVSKPGLQSKM

SEQ ID NO: 7295 - protein, 221 aa, Brassica juncea
GIEFDEVLIILAKRQQLTPEFKEINPLGKVPTIVDGRLKLFESHAILIYLASAFPSVVDHWYPNDLSKRAKIHSVLDWHHTNLRPGAAGYTMNSVLAPFLGRSLDSKAAAEAETILTKSLSTLETFWLKGNGKFLLGSNQPSIADLSLVCELMQLQVLDEKDRLRLFSPYKKVEEWIENTRKATQPHFDLVHKILYLAKDKFDKQRKMGTTVSKPGFQSKL

SEQ ID NO: 7296 - protein, 244 aa, Thellungiella halophila
MKLKVYTDRMSQPSRAVIIFCKVNGIQFDEILISLAKRQQLAPEFKDINPLGKVPAIVDGRLKLFESHAILIYLSSAFPSVADHWYPNDLSKRAKIHSVLDWHHTNLRPGAAGYVLNSVLAPSLGLPLDPQAASKADKLLTKSLSTLETFWLKGNAKFLLGSNQPSIADLSLVCELTQLQLLDEKDRVRLLSPHKKVEQWIENTRKATMPHFDEVHEILFKAKQRFEKQREMGTVPKPGFQSKM

SEQ ID NO: 7297 - protein, 244 aa, Arabidopsis thaliana
MKLKVYADRMSQPSRAVIIFCKVNGIQFDEVLISLAKRQQLSPEFKDINPLGKVPAIVDGRLKLFESHAILIYLSSAFPSVADHWYPNDLSKRAKIHSVLDWHHTNLRRGAAGYVLNSVLGPALGLPLNPKAAAEAEQLLTKSLSTLETFWLKGNAKFLLGSNQPSIADLSLVCELMQLQVLDDKDRLRLLSTHKKVEQWIENTKKATMPHFDETHEILFKVKEGFQKRREMGTLSKPGLQSKI

SEQ ID NO: 7298 - protein, 652 aa, Arabidopsis thaliana
MKLKVYADRMSQPSRAVLIFCKVNEIQFDEILISLGKRQQLSPEFKEINPMGKVPAIVDGRLKLFESHAILIYLSSAYASVVDHWYPNDLSKRAKIHSVLDWHHTNLRPGASGYVLNSVLAPALGLPLNPKAAAEAENILTNSLSTLETFWLKGSAKFLLGGKQPSIADLSLVCELMQLQVLDDKDRLRLLSPHKKVEQWIESTRKATMPHSDEVHEVLFRAKDRFQKQREMATASKPGPQSKIIQFSSIGGTSDGPNLVQDTTDRKARRRKWSPPDDVILISAWLNTSKDRKVVVYDEQQAHTFWKRIGAHVSNSASLANLPKREWNHCRQRWRKINDYVCKFVGCYDQALNQRASGQSEDDVFQVAYQLYYNNYMSNFKLEHAWRELRHNKKWCSTYTSENSKGGGSSKRTKLNGGGVYSSSCNPESVPIALDGEEQVMDRPLGVKSSKQKEKKVATKTMLEEREADSRSRLENLWVLDEEEQVMDLPLGVKSSKQKERKVATKTMIEEREAANFRSRLGNLWLLKEKEEREADSRSRLENLWALKEKDIEEQKKLTRMEVLKSLLGRRTVQVGNTFPLCFSMMKKPRKNLISFARGSRPGNPNSIRSTLIEQCTSFSEHSRFLNCTNGSCEKPENVIELFQDLEYCLQP

SEQ ID NO: 7299 - protein, 63 aa, Brassica napus
MISVVVITELLVEYTAALAKLTAGILPRRQGDRDVVRIGGFSLRYPPRPTTTIPDFSSHLVDF

SEQ ID NO: 7300 - protein, 62 aa, Brassica juncea
MISVVIITELLVEYTAALAKLTAGILPRRQGDRDVVRIGGFSLRFPPRSTPIPDFSSHLVDF

SEQ ID NO: 7301 - protein, 62 aa, Brassica juncea
MISVVIITELLLEYTAALAKLTAGILPRRRGDGDVVRIGGFSLRYPPRSSPIPDFSSHLVDF

SEQ ID NO: 7302 - protein, 59 aa, Brassica juncea
MISVVIITELLVEYTAALAKLTAGILPRRQGDRDVVRIGGFSLRFPPRSTPIPDFSSHL

SEQ ID NO: 7303 - protein, 62 aa, Unknown
  Sequence found in Organisms: Brassica napus, Brassica juncea
MISVVIITELLLEYTAALAKLTAGILPRRRGDGDVVRIGGFSLRCPPRSSPIPDFSSHLVDF

SEQ ID NO: 7304 - protein, 94 aa, Arabidopsis thaliana
QVIPTKFHHLLSELKRHLLDHYSPANLPKKSIMISIVIITELLVEYTTALAKLTAGILPRRQGDGDVVRIGGFSLYCPPRSSPIPDFSSHLVDF

SEQ ID NO: 7305 - protein, 62 aa, Arabidopsis thaliana
MISIVIITELLVEYTTALAKLTAGILPRRQGDGDVVRIGGFSLYCPPRSSPIPDFSSHLVDF

SEQ ID NO: 7306 - protein, 62 aa, Brassica juncea
MISVVIITELLVEYTTALAKITAGILPRRQGDSDVIRIGGFSLRFPSRSTPVPDFSSHLVDF

SEQ ID NO: 7307 - protein, 62 aa, Brassica juncea
MISVVIITELLVEYTTALAKLTAGILPRRRGDNDVIRIGGFSLRFPSRSTPVPDFSSHLVDF

SEQ ID NO: 7308 - protein, 62 aa, Unknown
  Sequence found in Organisms: Brassica napus, Brassica juncea
MISVVIITELLVEYTTALAKLTAGILPRRRGDTDVIRIGGFSLRFPSRSTPVPDFSSHLVDF

SEQ ID NO: 7309 - protein, 62 aa, Arabidopsis lyrata
MISVVIITELLVEYTTALAKLTAGVLPRRQGDRNVLRIGGFSLPCPPRSSPVPDFSSHLVDF

SEQ ID NO: 7310 - protein, 62 aa, Arabidopsis lyrata
MISVVIITELLVEYTAALAKLTAGILPRRTGDRNSVRIGGFLLPTPSSTSMIPDFSSHLVDF

SEQ ID NO: 7311 - protein, 62 aa, Brassica juncea
MISVVIITELLVEYTTALAKITAGILPRRRGDSDVIRIGGFSLRFPSRSTPVPDFSSHLVDF

SEQ ID NO: 7312 - protein, 62 aa, Brassica napus
MISVVIITELLVEYTTALAKLAAGILPRRRGDGDVIRIGGFSLRFPSRSTPVPDFSSHLVDF

SEQ ID NO: 7313 - protein, 62 aa, Arabidopsis thaliana
MISVVIITELLLEYTTALAKLTAGVLPRRQGDRNVIRIGGFSLPCPPRSSPVPDFSSHLVDF

SEQ ID NO: 7314 - protein, 623 aa, Arabidopsis lyrata
MARKHATESIGEVTGKRKKRDRVEEEGDIYDGIENQDVVEDGKLPLEVGMVYYPVTPPSFIVSDALEPDFPLIYVNKVFEVFTGYHADEVLGRNCRFLQYRDPRAQRRHPLVDPVVVSEIRRCLEEGIEFQGELLNFRKDGTPLVNRLRLALIRDDDGTVTHVIGIQVFSETTIDLDRVSYPVFKHKQQLDQTSECLLPGGSPRFKEHHEDFCGILQMSDEVLAHNILSRLTPRDVASIGSACRRLRQLTKNESVRKMVCQNAWGKEITGTLEIMTKKLGWGRLARELTTLEAVCWRKFTVGGIVQPSRCNFSACAVGNRLVLFGGEGVNMQPLDDTFVLNLDAEYPEWQRVRVTSSPPGRWGHTLSCLNGSWLVVFGGCGRQGLLNDVFVLDLDAKHPTWKEVAGGTPPLPRSWHSSCTIEGSKLVVSGGCTDAGVLLSDTFLLDLTTDKPTWKEIPTSWAPPSRLGHSLSVFGRTKILMFGGLANSGHLKLRSGEAYTIDLEDEEPRWRELECSSFTGAVVPPPRLDHVAVSMPCGRVIIFGGSIAGLHSPSQLFLIDPAEEKPSWRILNVPGKPPKLAWGHSTCVVGGTRVLVLGGHTGEEWILNELHELCLASRQDSDL

SEQ ID NO: 7315 - protein, 601 aa, Glycine max
MRNEEEEVYEEEESELPLKPGFFFYPTTPTSFVVSDALEPDFPIIYVNKVFEISTGYRADEALGRNCRFLQYRDPRAQRRHPLVDPVVVSEIRRCLEEGVEFQGELLNFRKDGTPLVNRLRLAPIHDDDGTVTHVIGIQLFSEANIDLNRVSYPVFKETCNQDFDKTGKYNPKSGQSLYSQHQEMCGILQLSDEVLAHNILSRLTPRDVASIGSVCRRIRQLTKNEHVRKMVCQNAWGKEVTGTLELMTKKLGWGRLTRELTTLEAVCWRKLTVGGAVEPSRCNFSACAAGNRLVLFGGEGVDMQPMDDTFVLNLDAKNPEWRRVSVKSSPPGRWGHTLSCLNGSWLVVFGGCGRQGLLNDVFVLDLDAQQPTWREVCGGTPPLPRSWHSSCTIEGSKLVVSGGCTDAGVLLSDTYLLDLTTDNPTWREIPTSWAPPSRLGHSLSVYGRTKILMFGGLAKSGHLRLRSGEAYTIDLEDEQPQWRQLEYSAFTGLASQSAVVPPPRLDHVAVSMPCGRIIIFGGSIAGLHSPSQLFLLDPSEEKPSWRILNVPGQPPKFAWGHSTCVVGGTRVLVLGGHTGEEWILNELHELCLASRQDSDL

SEQ ID NO: 7316 - protein, 629 aa, Cucumis sativus
MPMAKNDDEPELHSSGKRLKCSKHDDEQYHLGNEEEEEEQVTELPLKPGLFFYPMAPTSFVVSDALEPDFPIIYVNKVFEIFTGYRADEVLGQNCRFLQYRDPRAQRRHPLVDPVVVSEIRRCLEEGVEFQGELLNFRKDGTPMVNRLRLAPIHDDDGTVTHIIGIQVFSETKIDLNRLSYPVFKENCAIKYDLSGKSAHLIDQSPFGHHKEICGILQLSDEVLAHNILSRLTPRDVASVGSVCRRIRQLTKNEHLRKMVCQNAWGREVTGTLEQMTKKLGWGRLARELTTLEAVCWRKMTVGGAVEPLRCNFSACAAGNRLVLFGGEGVNMQPMDDTFVLNLDAANPEWRRVSVKSSPPGRWGHTLSCLNGSWLVVFGGCGSQGLLNDVFVLDLDAQQPTWKEISGGAPPLPRSWHSSCMIEGSKLVVSGGCTDAGVLLSDTYLLDLTTDKPTWREIPTSGTPPSRLGHSLSVYGRTKILMFGGLAKSGHLRLRSGEAYTIDLEEEEPQWRQLECSAFTGIGGQSAVVPPPRLDHVAVSMPCGRIIIFGGSIAGLHSPSQLFLLDPAEEKPSWRILNVPGQPPKFAWGHSTCVVGGTRVLVLGGHTGEEWILNELHELCLASRQDSDL

SEQ ID NO: 7317 - protein, 632 aa, Gossypium hirsutum
MSKGEEVMQSSGKRQRFAKDEVKRQEMEEEEEQQQQEDDDEEEESQLPKKPGLLYYPTTPTSFVVSDALEPDFPIIYVNKVFEVFTGYRADEVLGRNCRFLQYRDQCAQRRHPLVDPFVVSEIRRCLEEGIEFQGELLNFRKDGTPLVNILKLAPIHDDDGIVTHIIGIQVFSEAKLDLNRVSYPVFKETCNQQLDESAQYSHFSNPPFSQHREICGILQLSDEVLAHNILSRLTPRDVASIGSVCRRIRQLTKNEHVRKMVCQNAWGREVTGTLEMMTKKLGWGRLARELTTLEAVCWRKLTVGGAVEPSRCNFSACAAGNRLVLFGGEGVNMQPMDDTFVLNLDAANPAWQRVSVESSPPGRWGHTLSCLNGSWLVVFGGCGRQGLLNDVFVLDLDAKQPTWKEVSGGAPPLPRSWHSSCTIDGSKLVVSGGCTDAGVLLSDTYLLDLTTDKPTWKEIPTSWAPPSRLGHSLSVYGRTKILMFGGLAKSGNLRLRSGEAYTIDLEDEEPQWRQLDCSAFTSVGSQNAVVPPPRLDHVAVSMPCGRIIIFGGSIAGLHSPSQLFLLDPSEEKPSWRTLNVPGQPPKFAWGHSTCVVGGTRVLVLGGHTGEEWILNELHELCLASRQDSDSS

SEQ ID NO: 7318 - protein, 626 aa, Manihot esculenta
MSNHEKEEDDDEFQGSGKRLKCTKAEEEDDDDEEELEEEGQSEIPLDAGFFFYPTTPTSIVVSDALEPDFPIIYVNKVFEIFTGYRADEALGRNCRFLQYRDPRARRRHPLVDPVVVSEVRRCLEEGIEFQGELLNFRKDGTPLVNRLRLAPIHDDDGTVTHVIGIQVFSEAKIDLNRVSYPVFKETCNQQCDQAAKFSHLSGQSPFNHHQEICGILQLSDEVLAHNILSRLTPRDVASIGSVCRRIRQLTKNEHVRKMVCQNAWGREVTGALELMTKKLGWGRLARELTTLEAVCWRKLTVGGAVEPSRCNFSACAAGNRLVLFGGEGVDMQPMDDTFVLNLDAANPEWERVSVKSSPPGRWGHTLSCVNGSWLVVFGGCGREGLLNDVFVLDLDAKQPTWKEVSGGTPPLPRSWHSSCTVEGSKLVVSGGCTDAGVLLSDTYLLDLTTDKPTWREIPTSWAPPSRLGHSLSVYGRTKILMFGGLAKSGHLRLRSGEAYTIDLEDEEPQWRQLDCNAFTGVGSQSSVVPPPRLDHVAVTMPCGRIIIFGGSIAGLHSPSQLFLLDPSEEKPSWRILNVPGQPPKFAWGHSTCVVGGTRVLVLGGHTGEEWVLNELHELCLASRQD

SEQ ID NO: 7319 - protein, 630 aa, Glycine max
MPKEKEDVQNSGKRLKCTRNEEEEKEQYEQVEADEEEEEEEDSELPLKLGLFFYPTIPTSFVVSDALEPDFPIIYVNKVFEIATGYRADEALGRNCRFLQYRDRRAQRRHPLVDPVVVSEIRRCLEEGVEFQGELLNFRKDGTPLVNRVRLTLIHDDDGTVTHVIGIQLFSEANIDLNRVSYPVFKETCNQDFDKNGKYTPKSGQSLYSQHQEMCSILQLSDEVLAHNILSRLTPRDVASIGSVCRRVRQLTKNEHVRKMVCQNAWGKEVTGTLELMTKKMGWGRLTRELTTLEAVCWRKLTVGGAVEPSRCNFSACAAGNRLVLFGGEGVDMQPMDDTFVLNLDAKNPEWRRVSVKSSPPGRWGHTLSCLNGSWLVVFGGCGRQGLLNDVFVLDLDAQQPTWREVCGGTPPLPRSWHSSCTIEGSKLVVSGGCTDTGVLLSDTYLLDLTTDNPIWREIPTSWAPPSRLGHSLSVYGRTKILMFGGLAKSGHLRLRSGEAYTIDLEDEQPQWRQLEYSAFTGLASQSAVVPPPRLDHVAVSMPCGRIIIFGGSIAGLHSPSQLFLLDPSEEKPSWRILNVPGQPPKFAWGHSTCVVGGTRVLVLGGHTGEEWILNELHELCLASRHDSDL

SEQ ID NO: 7320 - protein, 822 aa, Oryza sativa
MSMDKTHLMCFYPSKITMGGVWTGDNPLDFSIPLLLFQILLITSTTRAATLLLSPLRLPTYISQILASFLLGPSILGHLPHFSNLVFPVRSLFVLESMALLGLVYYTFIVGVEIEVSAITRAGIHSFGFAVGCALPPFLVGALTGYVALSTDDKRKGDTFLNKLSFPIFLGSTFSSTAFSVLARNIAELKLAGTDVGQLTLSASLINDTFAWTGLTVATVLGHSRCTITQTTWTLTSGVVIFGASYLLLRPMLLRLARRAAEGEAVGEDRECWILIGVMVAALVADAGGTHAIFGAFVFGLAVPNGPVGVALVEKVEDFVVGALLPLFFALSGLRTDTAKITNMHSAVLLMVAAMVAAVLKVAAAIGVAGVFGMPLSDGTSIGLLLNTKGIIELVILNIARNKGIMSDQSFTVLVFVSALITAMVSPFLGMVVKPARRLVFYKRRTVAWAHPESELRVLACVHVPRDVPALLTLLDVVTPSSRSPVGVLALHLIEFVGRSSALLLINASAPSSSSYDASVHGRSHTEMQFKHISHAFMAYEEQSVGVSARTMAAVSPYESMHEDITSAAENQHSALILLPFHKYRSVDGGLEVSHPAIQPLNCNVQSFSPCTVGILVDRGLAAVPGGGYRVVALFFGGSDDREVAALATRMVRNPTIDLTLLRFVQKGGSFTASEFDALKERKADEGCLRDFLERANEGGGATVEYRERGVFNASEMVGEIQSVEAMGNKDLFVVGKVPGGSGLTAGMAEWSESPELGPIGDLLASKDFQTTASVLVLQAYGRPVAVVGAGAGAMSVDFGGDSVAMAERTASGRRPWARPGV

SEQ ID NO: 7321 - protein, 151 aa, Secale cereale
PRVRALTRPRQMASTVLLLLVAALACVLGGADAKLGRLVVSGVVPCNTGSLIDIATSPAFPNAEVELRCAGQVVAGATTNTNGSFTMEADLTSALAAFIGRCSLVVDTPLIKCDAQLPPAGRLVSYLQGPLTRLLGGIFHLFPAGFSFHAR

SEQ ID NO: 7322 - protein, 150 aa, Triticum aestivum
RNQSSDAPRQMASTVALLLVAALACVLGGADAKLGRLVVSGVVPCKTGSLIDIATSPVFPNAEVELRCAGQVVAGATTNTNGSFTMEADLTSALAAFIGRCSLVVDTPLIKCDAQLPPVGKLVSYLQGPLTRLLGGIFHLFPAGFSFHSR

SEQ ID NO: 7323 - protein, 140 aa, Oryza sativa
MASRVVVLLVVAAACVLGAADAKLGRLVVTGVVPCNTGSLIDIATSPAFPNADVELRCAGKLVAGATTNSNGSFAMEADLTSGLAMLIGGCKLVVDTPLIKCDANLPAAGSLVSYLQGPLTRLLGGIFRLFPAGFSFHAH

SEQ ID NO: 7324 - protein, 153 aa, Cajanus cajan
MACVALRPVCGKSYSTRGEFTGCSSPHLKDSILIYLTVGESVIPMHIMEADSIASVKLRIQTFKGFFVKSQKLVFEGKELARNRSCVRDYGVGDGNVLHLVLRLSDVKAITVRTMCGKEFGLYVQKSRNVGYVKQQIEKRARVLGSQGSRTGM

SEQ ID NO: 7325 - protein, 196 aa, Vigna unguiculata
PIPSPEGSGGAYLMQDSSGLKYISVFKPIDEEPMAINNPRGLPISEDGEGLKKGTRVGQGALREVAAYILDHPRKGPRSYHNNDEPGFAGVPPTVLVKCLHKGFHNVEDYQNVSGNAKIGSLQMFMRNIGSCEDIGPSAFPVEEVHKISVLDIRLVNADRHAGNILISKDGEDGHTILIPIDHGYCLPESFERLHF

SEQ ID NO: 7326 - protein, 105 aa, Solanum phureja
VQDEGIFLLASSQPKKRAGRKKFKETRHPIYRGVRRRDNNKWVCEVREPIEQKRIWLGTYPTPEMAARAHDVAALALRGNLATLNFADSSWRLAVPVSKDPEELR

SEQ ID NO: 7327 - protein, 181 aa, Solanum phureja
MNNNSSLYSSDLNPLSATTPSDEEGLILLLASSRPKKRAGRKKFKETRHPVYRGVRRRNNNKWVCELREPSQQKRIWLGTYPTPEMAARAHDVAALALRGNLATLNFADSRWRLPVPASKDPKDIRQAAVIAAQAFSQDTEVDYMNEEVNSNTTDEIDIARVNNGSSSDFSAKELSMDMEN

SEQ ID NO: 7328 - protein, 336 aa, Solanum tuberosum
ESLRLCFHNFLSFHLSIIVKIFRWLFSPLPTIKRFPLFVPFIDAYISLLFRFSNLSPCTLDLDDQTTIHFWAPNHRRYDKPNLVLIHGYGGDAKWQFMYQVKSLAQSFNLYIPDLLFFGKSYTTRKERTEEFQAKCVVQGLKELGVRNCSMFAISYGGFVGYRMAEMNPEMVEKVVILSSGVGCSKDQKEEQLKKIGRDPVELLIPAKPEDLHVLVNLSIYKYNPFKWAPDYFLQEFIDMISRTYLKEKQELVHHLLSNHTDCRLPILNQETLLIWGDKDRVFPLMFGYQLQRHLGPKAKLEIIKNTGHAANIESPDSVNALIKAFILPQSKDLNG

SEQ ID NO: 7329 - protein, 337 aa, Solanum phureja
MESLRLCFHNFLSFHLSIIVKIFRWLFSPLPTIKRFPLFVPFIDAYISLLFRFSNLSPCTLDLDDQTTIHFWAPNHRRYDKPNLVLIHGYGGDAKWQFMYQVKSLAQSFNLYIPDLLFFGKSYTTRKERTEEFQAKCVVQGLKELGVRNCSMFAISYGGFVGYRMAEMNPEMVEKVVILSSGVGCSKDQKEEQLKKIGRDPVELLIPAKPEDLHVLVNLSIYKYNPFKWAPDYFLQEFIDMISRTYLKEKQELVHHLLSNHTDCRLPILSQETLLIWGDKDRVFPLMFGYQLQRHLGPRAKLEIIKNTGHAANIESPDSVNALIKAFILPQSKDLNG

SEQ ID NO: 7330 - protein, 329 aa, Solanum melongena
MESLCLCLHNLLSFHLSIISTLFQWLLSPLPTIKRFPIFVPFIDAYVSFLYRFSNLSPCTLDLDEHTTIQFWAPNHRRFDKPNLVLIHGYGGDAKWQFMYQIKSLTESFNLYIPDLIFFGNSHSTRKDRTVEFQAKCVAEGLKGLGVKNCSMFAISYGGFVGYRMAEVYPEMVEKVVILSSGVSCTKDQKEEQLKKIGRNPVELLIPAKPADLHVLVNLSIYKYNPFKWAPDYFLQEFIDMISRSYLKEKQELVHHLLSSHTDCILPILNQETLLIWGDKDRVFPLMFGHQLQRHLGPRAKLEIIKDTGHAANIESPDSVNALIKAFII

SEQ ID NO: 7331 - protein, 237 aa, Ocimum basilicum
MADDDFLQLLKRIGAFLTLKISNLSQTLDSRSAGAIAGLAFAIVFIWKIMRSPSGPQRRHPKQQAVTPGSSGVSSHFSENVPTSEVSPPSENSNAQNVIDEFFQPVKPTLGQIVRQRLGEGRKVTCRLLGVILEETSPEELQKQATVRSSALEVLLEITKFCDLYLMERVLDDESEKKVLLALEDAGVFTSGGMVKDKVLFCSIENGRTSFVRQLEPDWHIDTNPEIVFQLARFIKY

SEQ ID NO: 7332 - protein, 268 aa, Coffea canephora
MADNSKEEFLQLVKRFGAFLTFKISNLFQRLDSRSVGALAGLAFAIVFTWRIMRSPSGPQRRSPKRQATAPSSSGVSNANADSALPVVAASSEDSTAQNVIDEFFQPVKPTLGQIVRQRLSEGRKVTCRLFGVILEETSPEELQKQATVRSSVLELLLEITKFCDLYLMERVLDDESEKKALLALEDAGVFTSGGLVKDKVLFCSTENGRTSFVRQLEPDWHIDTNPEIITQLARFIKYQLQISPTKPERSASNVYFSSSLEQFFGCV

SEQ ID NO: 7333 - protein, 912 aa, Solanum phureja
MQNSDFLLMVRSGDDSTLTRMHNYMASGEIMRQESLRHASIPCSPLDDELYDEPCYKVESTGAIVTLSSSVSLLYLYCSRLPSDGYFKPNPRCVIDKETGTCTLQLPKSCPLQRIISVQGNNKISKQLACLDACKELHRMGALTDNLVPDIMEEETINKESECQIHTVEELKYFPPELVSHCGNDSEALYYCYLVELQHDFYNDFQLHGIILAVRTRLKFDDEIMAFDLDVDRRGRLQVQLNYHKVVALTSEEIQRCRRFQSSVFRILLDRDLSKLQDALAAVQLPIGSAVSDYLLLPSLGSTPEINWKCVNSLLFPSQVLGDKHMDCCSTQGCKRSVSTKTGVVCSCMLENSLVFTPHNGHIYCITGFLDNLDCNSLLDMRTGEPITYIKYYKKRHGINICFEEEPLLRGKHICKVHNYLQRCRTQKAKDSTDSSVELPPELCSLIMSPLSISTLNTYSYVPSIMHRIESLVMASNLKRMHLDHCTLNIFIPTVKVLEAMTTKKCLEKFHLESLETLGDSFLKYAASIQLFKTYENHHEGLLTVKKNKIISNDALCRLGCARKIPGFIRNEPFDLKAWLIPGDNSQIHTFDEEFLTSSDKMYSREKQKFKSKRVADVVEALIGAYLSSGGEVAALSFMKWLGVDIDFVDAPLPRHFPMNAEKLINVRYLESLLHYKFNDPSLLVEALTHGSYMLPEIPRCYQRLEFLGDAVLDYVVTAHLYFKYPGLTPGLITDLRSASVNNECYAQSAVKAGLHKHILHASQDLQRQILGTVEDFEKLDLLSTFGWEAETTFPKVLGDVIESLGGAIFVDSGFNKDTTFQSIRPLLEPLVTPQTVKLQPVRELSELCDQKGYIKKKDVVSRENGVAYITVEVEANGVIHKSTCSGRDKIMAKKVASKNVLKSLKECPSNA

SEQ ID NO: 7334 - protein, 912 aa, Solanum lycopersicum
MQNSDFLLMVRSGDDSTLTRMHNYMASGEIMRQESLCHASIPCSPLDDELYDEPCYKVESTGAIVTLSSSVSLLYLYCSRLPSDGYFKPNPRCVIDKETGTCTLQLPKSCPLQRIISVQGNSKISKQLACLEACKELHRVGALTDNLVPDIMEEETINKELECQIHTVEELKYFPPELVSHCGNDSEAVYYCYLVELQHDACNDFQLHGIILAVRTRLKFDDEIMAFDLDIDRRGRLQVQLNYHNVVTLTSEEIQRCRRFQSSIFRILLDRDLSKLQGALAAVQSPIGSAVSDYLLLPSLGTTPEINWKCVNSLLFPSQALEAKHMDCCSTQGRKRSVSTKTGVICSCMLENSLVFTPHNGHIYCITGFLDNLDCNSLLDTRTGEPITYIEYYKKRHGINICFEEEPLLRGKHICKVHNYLQRCRIQKAKDSTDSSVELPPELCSLIMSPVSISTLNTYSYVPSIMHRIESLVMALNLKRMHLDHCTLDIFIPTIKVLEAVTTKKCLEKFHLESLETLGDSFLKYASSIQLFKTYENHHEGLLTIKKNKIISNDALCRLGCARKIPGFIRNEPFDLKAWLIPGDNSQIQTFDEEFLTSSDKMYSRGKQKFRSKRVADVVEALIGAYLSSGGEVAALSFMKWLGVDIDFVDAPLPRNFPMNAEKLINVRYLESLLHYKFNDPSLLVEALTHGSYMLPEIPRCYQRLEFLGDAVLDYVVTAHLYFKYPGLTPGLITDLRSASVNNECYAQSAVKAGLHKHILHASQDLQRQILSTVEDFEKLDLLSMFGWEAETTFPKVLGDVIESLGGAIFVDSGFNKDITFQSIRPLLEPLVTPQTVKLQPVRELSELCDQKGYIKKKDVISRENGLAYITVEVEANGVIHKSTCSGRDKIMAKKVASKNVLKSLKECPSNA

SEQ ID NO: 7335 - protein, 544 aa, Solanum tuberosum
DCNSLMGVRTEESITYREHFKKGYGINICFEEEPLLRGKHISKKAKDSSVELPPELCSLIISPLSISTLNTYSYVPLIMHRIESLIMASKLKRMHLDHCTLNVLIPTAKILEAITTKNCLEKFHLESLETLGDSFLKYAASIQLFKTYENDHQGLLTVKKKQIISNAALCKLGCARKIPGFIRNEPFNLKAWIIPGDNSQVHSFDEEFLTSSDKMFSRVKRKIKSKRVADVVEALIGAYLSSGGEVAAFSFMKWLGVDINFVDAPILRHFPMKAEKLVSVRYLESLLHYKFNDPSLLVEALTHGSYKLPEIPRCYQRLEFLGDAVLDYVVTTHLYFKYPGLTPGLITDLRSASVNNECYALSAVKAGLHKHILHDSQDLQRHIFSTVEDFKKLDLVSTFGWEAETTFPKVLADVIESLAGAIFVDSGFNEDTTFQSIRPLLEPLITPQTLKLHPARELNELCAHKGCIKKKNVVFRENGVVYITVEVEANGAIHKETHSGRNKNIPRRWLAKKCSSLSENIHTMHSSSSFFLLLQLTKILGYLF

SEQ ID NO: 7336 - protein, 205 aa, Nicotiana tabacum
MAESQLVHPPLVTYLSMIALLTLAPPFVILMWYTNVHADGSVLQTFNYLRENGLQGLIDIWPRPSAVAGKIIICYALFEAALQLLLPGKTVQGPISPTGHRPVYKANGMAAYAVTLITYLSLWWFGIFNPTIVYDHLGEILSTLNFGSLIFCLFLYIKGHVAPSSTDHGSSGNIIIDFYWGMELYPRIGKHFDIKVFTNCRFGMI

SEQ ID NO: 7337 - protein, 242 aa, Solanum tuberosum
QWWRTSWYHSPLITYGSMLSLLSFTPPFVILMWYTNVHADGSILKTFNHLRENGLQGLIDIWPKPTAIAGKLIICYALFEAALQLLLPGKTVEGPISPTGHRPVYKANGMAAYAVTLITYISLWWFGIFNPAIVYDHLGEILSTLIFGSLVFCVLLYIKGHVAPSSTDSGSSGNIIVDFYWGMELYPRIGKHFDIKVFTNCRFGMMSWAVLAVTYCIKQHEEYGRVSDSMLVNTILMLVYVT

SEQ ID NO: 7338 - protein, 331 aa, Solanum phureja
MVENKLVHSPLITYGSMLSLLSFTPPFVILMWYTNEHADGSILKTFNHLRENGLQGLIDIWPKPTAIAGKLIICYALFEAALQLLLPGKTVEGPISPTGHRPVYKANGMAAYAVTLITYISLWWFGIFNPAIVYDHLGEILSTLIFGSLVFCVLLYIKGHVAPSSTDSGSSGNIIVDFYWGMELYPRIGKHFDIKVFTNCRFGMMSWAVLAVTYCIKQHEEYGRVSDSMLVNTILMLVYVTKFFWWEAGYWNTMDIAHDRAGFYICWGCLVWVPSIYTSPGMYLVKQPVNLGLQVFLHPRRICYMHIRYKVIANKHYLLFIYTQLLFWDLY

SEQ ID NO: 7339 - protein, 51 aa, Petunia hybrida
MVERVSHRDNLRTFIQKSEDVEKRCFARAIKSYCELRILPYEDNKTVVFRS

SEQ ID NO: 7340 - protein, 327 aa, Mimulus guttatus
MSFLGRCCGRSSPQVNVFAKRSFKSLKFPGESLDDITSPALVHGIHVFHCPDEVGIVAKLSECIASKGGNILNADIFVPEKENVFYSRSEFVFDPAKWPRVQMDEDFSKLSKTFNAMKSVVRVPSRDPKYKIAVFASKQDHCLADLLHGWQDKRLPVDITAVISNHDRGPNTHVMRFLERHGIPYHFLDSNKEDKNEGDILNLVEGTDFLVLARYMQILSRNFLQSYGKDIINIHHGLLPSFKGGNPSKQAFDAGVKLIGATTHFVTEELDEGPIIEQMVERVSHRDNLRSFVQKSENLEKQCLAKAIKSYCELRVLPYEKNKTVVF

SEQ ID NO: 7341 - protein, 119 aa, Capsicum annuum
TRARYMQVLSGDFLKSYNKDIINIHHGLLPSFKGSNPSKQAFDAGVKLIGATTHFVSEELDSGPIIEQLVERVSHRDNLRTFIQKSEDVEKRCLAKAIKSYCELRIFPHEANKTVVFRS

SEQ ID NO: 7342 - protein, 84 aa, Citrus sinensis
PTRPGKDVINIHHGLLPSFKGGKPAKQAFDAGVKLIGATSHFVTEELDAGPIIEQMVERVSHRDNLRTFVQKSEDVEKNVLQRL

SEQ ID NO: 7343 - protein, 293 aa, Nicotiana tabacum
  misc_feature (43)..(43): Xaa can be any naturally occurring amino acid
  misc_feature (45)..(45): Xaa can be any naturally occurring amino acid
  misc_feature (68)..(68): Xaa can be any naturally occurring amino acid
  misc_feature (103)..(103): Xaa can be any naturally occurring amino acid
GSSSNSLVHGIHAFHCPDEVGIVAKLSDCIASRGGNILNADVXVXEDKNVFYSRSEFAFDPAKWPRGXMDEDFFKLSKMFNAMKSVVRVPEIDPKYKIAVLAXKQDHCLVDLLHRWQNGRLPVDVTSVISNHDRGPDAHVIRLLERHGIPHYYLPTTMGTKREVEILKLVHDTDFLVLARYMQVFSAEFLESYGKDIINIHHGLLPSFKGGSPSKQAFEAGVKLIGATSHFVSEGLDAGPIIEQMVERVSHRDNLRSFIQKSEDLEKQCLAKAIKSYCELRVLPYEKDKTVVF

SEQ ID NO: 7344 - protein, 227 aa, Citrus sinensis
MTLLRRLSSSLQQVVKFTNRSFKSLKFPGEPIESSVSSTLTHGIHVFHCPDEVGIVAKLSECIASRGGNILAADVFVPEKKNVFYSRSEFIFDPIKWPREQMDEDFFKLSKMFNAMRSVVRVPDIDPKYKVAVLASKQEHCLVDFLYGWQEGKLPVEITCVISNHDRGPNSHVIRLLERHGIPYHYLCAKENKREEELLELVQNTDFLVLARYMQPVPLAERGLPWL

SEQ ID NO: 7345 - protein, 328 aa, Arabidopsis lyrata
MIRKVSTTSCLSATAFRSFTKWSFKSSQFHGESLDSSVSPLLIPGVHVFHCPDVVGIVAKLSDCIAAKGGNILGDDVFVPENKNVFYSRSEFIFDPVKWPRRQMDEDFQTIAQKFSALSSVVRVPSLDPKYKIALLLSKQDHCLVEMLHKWQDGKLPVDITCVISNHERAPNTHIMRFLQRHGISYHYLPTTDQKKIEEEIFELVKDTDFLVLARYMQLLSGNFLKGYGKDVINIHHGLLPSFKGRNPVKQAFDAGVKLIGATTHFVTEELDSGPIIEQMVERVSHRDNLRSFVQKSEDLEKKCLMKAIKSYCELRVLPYGTQKTVVF

SEQ ID NO: 7346 - protein, 207 aa, Rhizophora mangle
VRVPVLDPKFKIAILASKQEHCLIELLHGWQDGRLPVDITCVISNHDRGPNTHVIRFLERTGIPYHYLHTTKENKREEEILNLVQHTDFLVLARYMQILSGSFLQKYGKDIINIHHGLLPSFKGGLPAKQAFEAGVKLIGATSHFVSEELDAGPIIEQMVERVSHRDNLRSFVQKSENLEKQCLAKALKSYYELRVFPYEDNRTVVF

SEQ ID NO: 7347 - protein, 328 aa, Arabidopsis thaliana
MIRRVSTTSCLSATAFRSFTKWSFKSSQFHGESLDSSVSPLLIPGFHVFHCPDVVGIVAKLSDCIAAKGGNILGYDVFVPENKNVFYSRSEFIFDPVKWPRRQMDEDFQTIAQKFSALSSVVRVPSLDPKYKIALLLSKQDHCLVEMLHKWQDGKLPVDITCVISNHERAPNTHVMRFLQRHGISYHYLPTTDQNKIEEEILELVKGTDFLVLARYMQLLSGNFLKGYGKDVINIHHGLLPSFKGRNPVKQAFDAGVKLIGATTHFVTEELDSGPIIEQMVERVSHRDNLRSFVQKSEDLEKKCLMKAIKSYCELRVLPYGTQRTVVF

SEQ ID NO: 7348 - protein, 125 aa, Carica papaya
MARWKASCGYNLCNKVLSGDFLKSYGKDIINIHHGLLPSFKGGHPSKQAFDAGVKLIGATSHFVTEELDSGPIIEQMVEAVSHRDNLRSFVQKSEDLEKKCLSKAIRSYCELRVLPYGTNKTVVF

SEQ ID NO: 7349 - protein, 324 aa, Thellungiella halophila
MIRRFSERASVFANNWILKSSASRFHGESLDSSVSPVLIPGVHVFHCQDAVGIVAKLSDCIAAKGGNILGYDVFVPENKNVFYSRSEFIFDPVKWPRNQVDKDFQNIAKTFGAMNSVVRVPSIDPKYKIALLLSKQDHCLVEMLHKWQDGKLPVDITCVISNHERASNTHIMRFLERHGIPYHYVSTTKENKREDEILELVKETDFLVLARYMQILSGNFLKGYGKDVINIHHGLLPSFKGGNPAKQAFDAGVKLIGATSHFVTEELDSGPIIEQMVESVSHRDNLRSFVQKSEDLEKKCLTKAIKSYCELRVLPYGTNKTVVF

SEQ ID NO: 7350 - protein, 323 aa, Arabidopsis lyrata
MIRRISERASCFAKNFPILKSSRFHGESLDSSVSPVLIPGVHVFHCQDAVGIVAKLSDCIAAKGGNILGYDVFVPENNNVFYSRSEFIFDPVKWPRNQVDEDFQTIAQRYGALNSVVRVPSIDPKYKIALLLSKQDHCLVEMLHKWQDGKLPVDITCVISNHGRASNTHVMRFLERHGIPYHYVSTTKENKREDDILKLVKDTDFLVLARYMQILSGNFLKGYGKDVINIHHGLLPSFKGGYPAKQAFDAGVKLIGATSHFVTEELDSGPIIEQMVESVSHRDNLRSFVQKSEDLEKKCLTKAIKSYCELRVLPYGTNKTVVF

SEQ ID NO: 7351 - protein, 352 aa, Brassica napus
MMMMRRIISERATCVSKNFILRSSASRFHGESLDSSVSPVLIPGVHVFHCQDAVGIVAKLSDCIAAKGGNILGYDVFVPENNNVFYSRSEFIFDPVKWPREQMSEDFQAIAQRFGAMNSVVRVPSIDPKYKIALLLSKQDHCLVEMLHRWQDGKLPVDITCVISNHERASNTHVMRFLERHGIPYHYVATTKDNKREDEILDLVKDTDFLVLARYMQILSGKFLKGYGKDVINIHHGLLPSFKGGYPAKQAFDAGVKLIGATSHFVTEELDAGPIIEQMVESVSHRDNLRSFVQKSEDLEKKMPNKSYKVILRTTCVTLWSKQDCCILIEQAKTICCMNNSKESYNNSLEDF

SEQ ID NO: 7352 - protein, 323 aa, Solanum lycopersicum
MNLLWRLVSPKFGPQVCKYSKRSLKSVKFPFGSSNSLLHGIHVFHCPDEVGIVAKLSDCIASRGGNILTADVFVPQDNNVFYSRSEFTFDPARWPRGEMDEDFFKLSKMFNAMKSVVRVPEIDPKYKIAVLVSKQDHCLVDLLHRWQNGRLPVDITSVISNHDRGPDAHVIRLLERHGIPYYYLPTTMGKKREVEILDLVHDTDFLVLARYMQVFSAEFLKSYGKDIINIHHGLLPSFKGGSPSKQAFEAGVKLIGATSHFVSEVLDAGPIIEQMVERVTHRDNLQSFIQKSEDLEKQCLVKAIKSYCELRVLPYEKEKTVVF

SEQ ID NO: 7353 - protein, 167 aa, Actinidia deliciosa
ITCIISNHDRGPNTHVTRFLERHGIPYHYLHTTTGNKREAEILDLVQNTDFLVLARYMQVLSGSFLSSYGKDVINIHHGLLPSFKGGNPSRQAFDAGVKLIGATSHFVTEELDSGPIIEQMVERVSHRDNLQSFIQKSENLEKQCLAKAIKSYCELRVLPYEESKTV

SEQ ID NO: 7354 - protein, 754 aa, Populus trichocarpa
MKFRYSNKLPIFAHSLRLSHQHHQRRQFFTSLLKRVQTASQVRASFNGSSGNPRGNIFLVPGATVATLLMLGALHARRLYDDKKVEEAREKGIEFEFQPDHKASFLRMLPLRSISRLFGSLTSVELPVWMRPHVYRAWARAFHSNLEEVALPLENYASLREFFVRTLKEGSRPIDPDPHCLVSPVDGTVLRFGELKGSGTMIEQVKGFSYSVSSLLGASSLLPVITEGDMHKESSEQQGNLKEKNKKSWWRFSLASPKIRDTVSACPAKGLYYCVIYLSPGDYHLIHSPADWNVLVRRHFSGHLFPVNERATRTIRNLYVQNERVVLEGLWEGGFMAIAAIGATNIGSIKLFIEPELQTNQRRQKILNSEPPDERVYALEGVGKSLKKGAEVAAFNLGSTVVLVFQAPTLKMLQNRDSSSEFRFSIRRGDRVRVGEALGRWHDFSYRIYIKRHRQDRKKNKDEKNPENVSFNSQLPRRDAVGIVAKLSECIASRGGNILGADIFVPQNKNVFYSRSEFIFDPVKWPRVQMDEDFLRISKMFDATRSVVRVPKLDPKFKIAVIASKQEHCLIDLLHSWQDGRLPVDITRVISNHDRGPDTHVIRFLERNGIPYHYLHTTKENKREEEILDLVQNTDFLVLARYMQILSGKFLQSYGKDIINIHHGLLPSFKGGNPSKQAFDAGVKLIGATSHFVTEELDAGPIIEQMVERVSHRDNIQSFVRKSENLEKQCIAKAIKSYCELRVLPYEENKTVVF

SEQ ID NO: 7355 - protein, 211 aa, Raphanus sativus
  misc_feature (2)..(2): Xaa can be any naturally occurring amino acid
  misc_feature (110)..(110): Xaa can be any naturally occurring amino acid
MXSVVRVPSLDPKYKIALLLSKQDHCLVEMLHKWQDGKLPVDITCVISNHERAPNTHIMRFLQRHGISYHYLPTTDQNKIEEEIFELVKDTDFIVLARYMQVLSGNFLKXYGKDVINIHHGLLPSFKGRSPAKQAFDAGVKLIGATTHFVTEELDSGPIIEQMVERVSHRDNLTSFVQKSEDLEKKCLMKAIKSYCELRVLPYGTHKTVVF

SEQ ID NO: 7356 - protein, 151 aa, Solanum phureja
VYSMYRSFGGNQGNNNDNHNNNGQLQGYGGGGGGGVMFPQPVRVVGSWVKVESVTDAWVEGYGLGRTDEEKLINLERDCCPGFISDGLNRVRWANKAYKAMVGAGAGEVVVWLVMKDDVRLPESKYTAAEYSSFYSLAGFGLSDAGSRKTR

SEQ ID NO: 7357 - protein, 268 aa, Capsicum annuum
HEGRWKRRYVKDHNKNGNSSSSNKKSNSGTSTGRKRKAASPEENESSDKTVSGGETVVTLPLLSESPERKDDSPTDHFAKKKEKNAPIWLSFGGNQRRLNNNNNNDSNGRLQLLQGYGGGVGMDRSVVMFPQSVRVVGSWVKVESVTDAWVEVYGLGRTDEEKLINLEQDTCPGFISDGLNRVRWANMAYKDLVGDGTPAGEVVVWLMMKEDVPLPESKTTAAFTCKVRVVRCGKEKNSLILPCDVWRMDGGGFAWRLDTEPALSLAR

SEQ ID NO: 7358 - protein, 154 aa, Nicotiana tabacum
QGYGGVGMDRSVLMLPQPVRVVGSWVKVESVTDAWVEGYGLGRTDEEKLVNLELDSCPGFVSDGLNRVRWANKAYKEMVSEGGVAEGEVVVWLVMKEDLRLPENKNTAAFTCQVRVIRSGKEKNSLILPCDVWRMDGGGYAWRLDTKAALSLGR

SEQ ID NO: 7359 - protein, 198 aa, Petunia hybrida
MASNALMSCGIAAVSPSVLSSSKSKFAAALPVYCAGVANGNSRFSMSAEWMPGQPRPPYLDGSAPGDFGFDPLGLGEVPQNLERYKESELIHCRWAMLAVPGILVPEALGLGNWVKAQEWAAVPGGQATYLGQPDPWGTLPTILAIEFLAIAFVEHQRSMEKDPEKKKYPGGAFDPLGYSKDPAKFEELKSRKLKMAA

SEQ ID NO: 7360 - protein, 265 aa, Ipomoea nil
IPNPIFSLPGHSPRSNKKLMASKLMSCGVAAVCSSVLSSSKSKFAAAVPLPVSANVTASGRITMSADWMPGQPRPPYLDGSAPGDFGFDPLRLGEVPENLERYKESELIHCRWAMLAVPGIIIPEALGLGNWVKAQEWAAIPGGQATYLGQPVPWGTLPTILAIEFLAIAFVEHQRSMEKDTEKKKYPGGAFDPLGYSKQDPAKLHELKVKEIKNGRLALLAFVGICVQQSAYPGTGPLENLASHLADPWHNNIGDILIPRNVSP

SEQ ID NO: 7361 - protein, 274 aa, Ipomoea nil
RCHFHLFFIPKPIFSLPDNFPRSLKEKMASRLMSCGVAAVCSSVLSSSKSKFATAVPLPVAANVTASGRITMSSSDWMPGQPRPPYLDGSAPGDFGFDPLGLGEVPENLERYKESELIHCRWAMLAVPGIIIPEALGLGNWVKAQEWAAIPGGQATYLGQPVPWGTLPTILAIEFLAIAFVEHQRSMEKDTEKKKYPGGAFDPLGYSKQDPAKLHELKVKEIKNGRLALLAFVGICVQQSAYPGTGPLENLASHLADPWHNNIGDILIPRTISP

SEQ ID NO: 7362 - protein, 276 aa, Gossypium hirsutum
  misc_feature (13)..(16): Xaa can be any naturally occurring amino acid
  misc_feature (20)..(20): Xaa can be any naturally occurring amino acid
  misc_feature (22)..(23): Xaa can be any naturally occurring amino acid
  misc_feature (27)..(27): Xaa can be any naturally occurring amino acid
PIVSRITNAGRLXXXXKITXRXXTKTXFPPMAATNTLMSCGIATAFPSVLSSSKSKFATATPLPSFGANVGHRVSMSADWMPGQPRPPYLDGSAPGDFGFDPLRLGEVPENLERYKESELIHCRWAMLAVPGILVPEALGYGNWVKAQEWAAVPGGQATYLGNPVPWGTLPTILVIEFLAIAFVEHQRSMEKDTEKKKYPGGAFDPLGYSKDPKKFEEYKVKEIKNGRLALLAFVGFCVQQSAYPGTGPLENLATHLADPWHNNIGDIIIPRSISP

SEQ ID NO: 7363 - protein, 130 aa, Rosa hybrid cultivar
MASNTLMSCGIATTAFPSVLSSSKSKFATAVQLPSVGVNASSRFSMSADWMPGQPRPPYLDGSAPGDFGFDPLRLGEVPENLERFKESELIHCRWAMLAVPGILVPEALGLGNWVFAQNGQQFQEAKPLT

SEQ ID NO: 7364 - protein, 200 aa, Salvia sclarea
MPPPPGSPCPPSGCRASPRPPYLDGSAPGDFGFDPLRLGEVPENLERYKESELIHCRWAMLAVPGILVPEALGLGNWVKAQEWAALPGGQATYLGNPVPWGTLPTILVIEFLSIAFVEHQRSMEKDPEKKKYPGHSTLSDTPRTPRSSRSSKSRRSRMVVLPCWHSWDSACSNQRTREPDHWRIWRRIWLTRGTTTLAMS

SEQ ID NO: 7365 - protein, 263 aa, Musa acuminata
  misc_feature (229)..(229): Xaa can be any naturally occurring amino acid
  misc_feature (242)..(242): Xaa can be any naturally occurring amino acid
MASSALRSCAVLFPSLLSSSKSQFVSSVAISCTNGASRFSMSADWMPGQPRPPYLDGSAPGDFGFDPLRLGEVPENLERYKESELIHCRWAMLAVPGILVPEALGLGNWVKAQEWAAIPGGQATYLGNPVPWGTLPTILVIEFFAIAFVEHQRSMEKDPEKKKYPGGAFDPLGYSKDPVKFEEYKVKEIKNGRLALLAFVGFCVQQSAYPGTGPLENLATHLADPWHNXIGDIVIPRSILPXTRPRERERQRELILSLLQNPM

SEQ ID NO: 7366 - protein, 249 aa, Bruguiera gymnorhiza
MAANAMMSCGIAAGFPSFLSSSKSKFATSIPLPIVNGASRVTMSAEWMPGQPRPPYLDGSAPGDFGFDPLRLGEVPENLERYKESELIHCRWAMLAVPGMLVPEALGLGNWVKAQEWAAVPGGQATYLGQPVPWGTLPTILVIEFLAIAFVEHQRSMEKDPEKKKYPGGAFDPFGLLQGPRKVQGKLRSKEIKNGPFKIGWRLWDSVFSNQLTLARDHWRTWPLIWLTHGTTTLGTLSSPDRFCLEELK

SEQ ID NO: 7367 - protein, 74 aa, Cleome gynandra
MASNTLMSCGVAAAASAAYPSRLSSSKSKFFAAGIPISNAANAAGRVTMSADWMPGQPRPPYLDGSAPGDFRPT

SEQ ID NO: 7368 - protein, 207 aa, Musa acuminata
MASAALRSCAVLFPSLLSSSKSQFNGSVSLPCANGASRFSMSAEWMPGQPRPPYLDGSAPGDFGFDPLRLGEVPENLERYKESELIHCRWAMLAVPGILVPEALGLGNWVKAQEWAAVPGGQATYLGNPVPWGTLPTILVIEFIAIAFVEHQRSMEKDPEKKKYPGGAFDPLGFSKDPAKFQEYKIKEIKNGRLALLAFVGFCVQQS

SEQ ID NO: 7369 - protein, 241 aa, Cicer arietinum
MGCNTLMSSIAISAFPSLLSSSKSRFATSLPIPNVASSSRFNMTADNWMPGQPRPPYLDGSAPGDFGFDPLRLGEVPENLERFKESELIHCRWAMLAVPGILIPEALGLGNWVKAQEWAAVPGGQATYLGNPVPWGTLPTILVIEFLAIAFVEHQRSMEKDPEKKKYPGGAFDPLGYSKDPKKFHQYKIKEVKNGRLALLAFVGICVQQSAYPGTGPLENLATHLADPWHNNIGNILIPPQ

SEQ ID NO: 7370 - protein, 218 aa, Allium cepa
  misc_feature (218)..(218): Xaa can be any naturally occurring amino acid
MAATGLRSCAVVYPSLLSSSKSKFTSSLALPAGTSASSRFSMSAEWMPGQPRPPYLDGSAPGDFGFDPLRLGEVPANLERFKESELIHCRWAMLAVPGILVPEALGLGNWVKAQEWAALPGGQATYLGNPVPWGTLPTILTIEFLAIAFVEHQRSMEKDPEKRKYPGGAFDPLGYSKDPEKLKELKVKEIKNGRLALLAFVGFCVQQSAYPGTGPLEX

SEQ ID NO: 7371 - protein, 244 aa, Unknown
  Sequence found in Organisms: Curcuma longa, Zingiber officinale
MASTALRSCAVLFPSLLSSSKSKFAAGSLTLPASHGASAGRFSMTADWMPGQPRPPYLDGSAPGDFGFDPLRLGEVPENLERYKESEVYHCRWAMAAVPGILIPEALGLGNWVKAQEWAAVPGGQATYLGNPVPWGTLPIILVIEFLAIAFVEHQRSIEKDTEKKKYPGGAFDPLGYSKDPVKFEEYKVKEIKNGRLAMLAFVGFCVQQSAYPGTGPLENLASHLADPWHNNIGNIVIPRSIVP

SEQ ID NO: 7372 - protein, 65 aa, Arabidopsis lyrata
MKEVRRYIDYTHPNGSVNEIWRQVTKKIPLIKLMINREKRMIKREGSDLQCSCLCLNQTGIIHGV

SEQ ID NO: 7373 - protein, 97 aa, Brassica napus
EWIRYAASNVFVYGSFQEPEVVKVMLDRTPEIISVTLPGFKRFRLKGRLYPCVIPSEDGEVHGKLLMGLTDEELENVDAVEGNEYERVTVGVVRGQF

SEQ ID NO: 7374 - protein, 165 aa, Brassica oleracea
EWLRCAAHNVFVYGSFQEPEVVKVMLDRTPEIISVTLPGFKRFRLKGRLYPCVIPSEDGEVHGKLLMGLTDEELENVDAVEGNEYERVTVGVVREDNSEKMTVKTYIWINKDDPDIDGEWDFEEWKRLHMKKFIETFKEIMEWKRNPQGKGRDDFNHVLRDAPSA

SEQ ID NO: 7375 - protein, 291 aa, Brassica napus
TSVISSSMFLTAMAANPLSANLAFNTIKQTIGWTDWAKAAIVPGMVSLIVVPFLLYLIYPPTVKSSPDAPKLAQEKLDKMGPMSKNELIMAATLFLTVGLWIFGAKLSVDAVTAAILGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVLAFLSNLMGGLTHYGIGSAPIFYGANYVPLSKWWGYGFLISIVNILIWLGVGGAWWKFIGLW

SEQ ID NO: 7376 - protein, 263 aa, Brassica napus
  misc_feature (260)..(260): Xaa can be any naturally occurring amino acid
MASLALSGSCSLAFPLKSRSLLLPRPPSSLNLLKKPLRSTESRFSSVKSPLHIALTKRSTLVKASSSAAASSSPAPVAPAPWQGAAIKPLLASIATGVIIWFLPVPEGVTRSAWQLLAIFLATIVGIITQPLPLGAVALLGLGASVLTKTLTFAAAFSAFGDPIPWLIALAFFFARGFIKTGLGNRVAYQFVRLFGSSSLGLGYSLVFSEALLAPAIPSVSARAGGIFLPLVKSLCVACGSNVGDGTEHRLGAWLMLTCXRRR

SEQ ID NO: 7377 - protein, 256 aa, Raphanus sativus
GAKAAIVPGIASLIVVPFLLYLIYPPTVKSSPDAPKLAQEKLDKMGPMSKNELIMAATLFLTVGLWIFGAKLSVDAVTAAILGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVLAFLSNLMGGLTHYGIGSAPIFYGANYVPLAKWWGYGFLISIVNILIWLGVGGAWWKFIGLW

SEQ ID NO: 7378 - protein, 284 aa, Brassica napus
MASLALSGSCSLAFPLKSRSLLLPRPPSSLNLLKKPLRSTESRFSSVKSPLHIALTKRSTLVKASSSAAASSSPAPVAPAPWQGAAIKPLLASIATGVIIWFLPVPEGVTRSAWQLLAIFLATIVGIITQPLPLGAVALLGLGASVLTKTLTFAAAFSAFGDPIPWLIALAFFFARGFIKTGLGNRVAYQFVRLFGSSSLGLGYSLVFSEALLAPAIPSVSARAGGIFLPLVKSLCVACGSNVGDGTEHRLGAWLMLMLPDVGDLFVYVLDGDGGESAECELGV

SEQ ID NO: 7379 - protein, 248 aa, Thellungiella halophila
GLVSLIVVPFLLYIIYPPTVKSSPDAPKLAQEKLDKMGPMSKNELIMAATLFLTVGLWIFGAKLGVDAVTAAILGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVLAFLSNLMGGLTHYGIGSAPIFYGANYVPLAKWWGYGFAISIVNILIWLGVGGAWWKFIGLW

SEQ ID NO: 7380 - protein, 202 aa, Brassica napus
MAATLFLTVGLWIFGAKLSVDAVTAAILGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVLAFLSNLMGGLTHYGIGSAPIFYGANYVPLSKWWGYGFLISIVNILIWLGVGGAWWKFIGLW

SEQ ID NO: 7381 - protein, 194 aa, Brassica rapa
  misc_feature (20)..(20): Xaa can be any naturally occurring amino acid
VGLWIFGAKLSVDAVTAAIXGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVLAFLSNLMGGLTHYGIGSAPIFYGANYVPLSKWWGYGFLISIVNILIWLGVGGAWWKFIGLW

SEQ ID NO: 7382 - protein, 396 aa, Cleome spinosa
FSAFGDPIPWLIALAFFFARGFIKTGLGNRIAYQFVRLFGSSSLGLGYSLVFSEALLAPAIPSVSARAGGIFLPLVKSLCVACGSNAGDGTEHKLGAWLMLTCFQTSVISSSMFLTAMAANPLSANLAYNTIKQTIGWTDWAKAAIVPGIASLIVVPLLLYIIYPPTVKSSPDAPKLAEEKLEKMGPMSKNELIMSATLLLTVGLWVFGGKLNVDAVTAAILGLSILLVTGVVTWKECLGEAVAWDTLTWFAALIAMAGYLNKYGLIEWFSQTVVKFVGGLGLSWQLSFGILVLLYFYSHYFFASGAAHIGAMFTAFLSVASALGTPPYFAAMVLAFLSNLMGGLTHYGIGSAPVFYGANYVPLAKWWGYGFIISVVNILIWLGVGGVWWKFIGLW

SEQ ID NO: 7383 - protein, 572 aa, Cucumis sativus
MASLALTSLYLPSLRSRLPNSESNARIRCSSLRSSIPKSAIFGSGVRTSFHIPSSLSNEAKFVKPGLNFGSSGRNLGGFTVRASSSSSSAAAAVPAPAPQPWQGAAIKPLIASIATGIILWFVPVPSGVSRNAWQLLAIFLATIVGIITQPLPLGAVALLGLGASVLTKTLTFSAAFSAFGDPIPWLIALAFFFARGFIKTGLGNRIAYQFVSLFGSSSLGLGYSLVFSEALLAPAIPSVSARAGGIFLPLVKSLCVACGSNVGDGTENRLGAWLMLTCFQTSVISSSMFLTAMAANPLSATLTYNTIKQTIGWTDWAKAAIVPGLISLIVVPLLLYVVYPPTVKSSPDAPKLAREKLEKMGPMTKNEIIMAGTLLLTVGLWVFGGVLNVDAVTAAILGLSVLLVTGVVTWKECLGEAVAWDTLTWFAALIAMAGYLNKYGLISWFSQTVVKFVGGLGLSWQLSFGILVLLYFYSHYFFASGAAHIGAMFTAFLSVASALGTPPYFGAIVLSFLSNLMGGLTHYGIGSAPVFYGANYVPLAQWWGYGFLVSVVNIIIWLGIGGIWWKAIGLW

SEQ ID NO: 7384 - protein, 119 aa, Tropaeolum majus
MFLTAMAANPLSANLAFNTIKQSIGWTDWAKAAIVPGLVSLIVVPFLLYLIYPPTVKSSPDAPKLVEEKLKSMGPMSKNETIMAVTLLLTVGYGFLVVSLVWMPLLLPYSDYLFFLLPG

SEQ ID NO: 7385 - protein, 426 aa, Mesembryanthemum crystallinum
IITQPLPLGAVALMGLGAAVLTKTLTFAAAFSAFGDPIPWLIALAFFFARGFIKTGLGNRIAYQFVKLFGASSLGLGYSLVFSEALLAPAIPSVSARAGGIFLPLVKSLCIACGSNVGDGTERKLGAWLMLTCFQTSVISSSMFLTAMAANPLSATLTLNTIGQTIGWMDWAKAAVVPGLVSLVVVPLLLYVIYPPEVKSSPDAPRLAAEKLEKMGPMSRNEIIMGVTLLLTVGLWVFGGVLNVDAVTAAILGLSILLITGVVTWKECLAESVAWDTLTWFAALIAMAGYLNKYGLIAWFSETVVKFVGGLGLSWQLSFGILVLLYFYSHYFFASGAAHIGAMFTAFLSVASALGAPPYFAAVVLAFLSNLMGGLTHYGIGSAPVFYGANYVPLAQWWGYGFVISVVNILIWLGVGGFWWKAIGLW

SEQ ID NO: 7386 - protein, 589 aa, Pinus taeda
MASAALSASSTVGIRAYNISATRPNEQSRPSSSISLVAAPARPFLQCRHSISRPHATAGTGSLFSSWWGRQQEIQSQKRPLFAPLEGLRHRRPTNAPPAGRPRASSAVAPPPAPPVQPWQGAALKPLAASIATGVLLWLVPAPAGVTKNAWQLLAIFLATIVGIITQPLPLGAVALMGLGAAVLTKTLTFAAAFSAFGDQIPWLIALAFFFARGFIKTGLGNRVAYQFVALFGSSSLGLGYSLVFSEALLAPAIPSVSARAGGIFLPLVKSLCVACGSNVGDGTERRLGSWLMLTCFQTSVISSAMFLTAMAANPLSVNLAAGAIGQTIGWTDWAVAALVPGLVSLIVVPLLLYVIYPPSVKSSPDAPKLAREKLQKMGPMTKNEIIMSGTLLVTVGLWIFGGMLKVDAVTAAILGLSVLLCTGVVTWKECLAESVAWDTLTWFAALIAMAGYLNKYGLISWFSQTVVKVVGGLGLSWQLSFGILVLLYFYSHYFFASGAAHIGAMFTAFLSVASALGTPPLFGAMVLSFLSNLMGGLTHYGIGSAPVFYGANYVPLAQWWGYGFLISIVNIVIWLGLGGVWWKALGLW

SEQ ID NO: 7387 - protein, 567 aa, Orobanche aegyptiaca
MASLALTSSLFLRPRPLPASKLRPPATAAPKSLGFAPTFRSSIQNICSSQNPITEKQTQFAYQNPAILIPAPKRVPLTVASALPAAPPAVSPPPGPWQGASMKPLLASIATGVILWLVPAPNGVSRIAWQLLSIFLATIVGIITQPLPLGAVALMGLGACVLTKTLTFAAAFSAFGDPIPWLIALAFFFARGFIKTGLGNRIAYQFVSLFGSSSLGLGYSLVFSEALLAPAIPSVSARAGGIFLPLVKSLCVACGSNVGDGTENKLGSWLMLTCFQTSVISSSMFLTAMAANPLAANLTASTINMSIGWMDWAKAAIVPGLVSLIVVPLLLYVIYPPTVKSSPDAPKLAKEKLEKMGPMSKNEIIMAGTLLLTVGLWIFGSVLNVDAVTAAILGLSVLLVTGVVTWKECLAESVAWDTLTWFAALIAMAGYLNKYGLISWFSQTVVKFVGGLGLSWQLSFGILVLLYFYSHYFFASGAAHIGAMFTAFLSVASALGTPPYLGAVVLAFLSNLMGGITHYGIGSAPVFYGAGYVPLAKWWGYGFLISIVNLLIWLGIGGVWWKAIGLW

SEQ ID NO: 7388 - protein, 452 aa, Phaseolus coccineus
WFTPVPAGVNRNAWQLLAIFLGTIVGIITQPLPLGAVAILGLGVSVLTKTLPFAAAFSGFGDPIPWLIALAFFFAKGFIKTGLGNRVAYQFVKLFGSSSLGLGYSLVFSEALLAPAIPSVSARAGGIFLPLVKALCVACGSNVGDGTETKLGAWLMLTCFQTSVITSAMFLTAMAANPLCATLTLNSINQTIGWLDWAKAAIVPGLVSLVLVPLILYVIYPPTLKSSPDAPKLAREKLATMGPMTTNEKIMTATLFLTVGLWVFGGVLNVDAVSAAILGLSVLLVTGVVTWKECLAEGVAWDTLTWFAALIAMAGYLNKYGLISWFSQTVVKFVGGLGLSWQLSFGILVLLYFYSHYFFASGAAHIGAMFTAFLSVSTALGTPPFFGAIVLSFLSNLMGGLTHYGIGSAPVFFGANYVPLAKWWGYGFLISIVNIVIWLGLGGVWWKFIGLW

SEQ ID NO: 7389 - protein, 560 aa, Glycine max
MASVALTTTALPYLRLRRNTAATLKPNRHSSISLSSLKPTLNASISSFPNFSLKKPSLVFNQKPSSLTVRASAASITPAPAPSSAPVQPWQGASIKPLIASIATGVILWFSPVPAGVNRNAWQLLAIFLGTIVGIITQPLPLGAVAILGLGVSVLTKTLPFAAAFSGFGDPIPWLIALAFFFAKGFIKTGLGNRVAYQFVKLFGSSSLGLGYSLVFSEALLAPAIPSVSARAGGIFLPLVKALCVACGSNAGDGTEHRLGAWLMLTCFQTSVITSAMFLTAMAANPLCATLTLNSINQTIGWLDWAKAAIVPGLASLVLVPLILYVIYPPTLKSSPDAPKLAKEKLEKMGPMTTNEKIMTATLFLTVGLWVFGGLLNVDAVSAAILGLSVLLVTGVVTWKECLAEGVAWDTLTWFAALIAMAGYLNKYGLISWFSQTVVKFVGGLGLSWQLSFGILVLLYFYSHYFFASGAAHIGAMFTAFLSVATALGTPPFFGAIVLSFLSNLMGGLTHYGIGSAPVFFGANYVPLAKWWGYGFLISIVNIIIWLGLGGVWWKFIGLW

SEQ ID NO: 7390 - protein, 594 aa, Picea glauca
  misc_feature (24)..(24): Xaa can be any naturally occurring amino acid
  misc_feature (332)..(332): Xaa can be any naturally occurring amino acid
MASAALAASSTVGIRAPHISAVQXNHHHHRSPPLSSIALAAAPARPFLQCRDSISRPHAAAGRNSLVSLWWGRQQKIQEQKRPLFAPLEGLRRRRPVKAPPTASPRASSAAVTPAPPAPPAQPWQGAALKPLAASIATGVIMWLVPAPAGVTKNAWQLLAIFLATIVGIITQPLPLGAVALMGLGAAVLTKTLTFAAAFSAFGDQIPWLIALAFFFARGFIKTGLGNRVAYQFVALFGSSSLGLGYSLVFSEALLAPAIPSVSARAGGIFLPLVKSLCVACGSNVGDGTEGRLGSWLMLTCFQTSVISSAMFLTAMAANPLSVNLAASAIGXTIGWTDWAVAALVPGLVSLIVVPLLLYVIYPPSVKSSPDAPKLAREKLQKMGPMTKNEIIMSGTLLVTVGLWIFGGMLKVDAVTAAILGLSVLLCTGVVTWKECLAESVAWDTLTWFAALIAMAGYLNKYGLISWFSQTVVKVVGGLGLSWQLSFGILVLLYFYSHYFFASGAAHIGAMFTAFLSVASALGTPPLFGAMVLSFLSNLMGGLTHYGIGSAPVFYGANYVPLAQWWGYGFLISVVNIVIWLGLGGVWWKVLGLW

SEQ ID NO: 7391 - protein, 287 aa, Picea glauca
SSAMFLTAMAANPLSVNLAAGAIGQTIGWTDWALAALVPGLVSLIVVPLLLYVIYPPTVKSSPDAPKLAREKLQKMGPMTKNEIIMSGTLLVTVGLWIFGGMLKVDAVTAAILGLSVLLCTGVVTWKECLAESVAWDTLTWFAALIAMAGYLNKYGLISWFSQTVVKVVGGLGLSWQLSFGILVLLYFYSHYFFASGAAHIGAMFTAFLSVASALGTPPLFGAMVLSFLSNLMGGLTHYGIGSAPVFYGANYVPLAQWWGYGFLISVVNIVIWLGLGGVWWKFLGLW

SEQ ID NO: 7392 - protein, 253 aa, Tragopogon dubius
AAIVPGLVSLIVVPFLLYLIYPPSVKSSPDAPKLAKERLEKMGPMTKNEIIMAGTLFLTVGLWIFGGMLNVDAVTAAILGLSVLLITGVVTWKECLAESVAWDTLTWFAALIAMAGYLNKYGLISWFSQTVVKFVGGLGLQWQASFGILVLLYFYSHYFFASGAAHIGAMFTAFLSVASALGTPPLFGAMVLAFLSNLMGGLTHYGIGSAPVFYGANYVPLGKWWGYGFLISVVNIIIWLGVGGVWWKFIGLW

SEQ ID NO: 7393 - protein, 553 aa, Glycine max
MASVALTTTALPSLRLRRNTTATLKPNRHASISLKPNLHASISSFPNFSLKKPHLISTRKPSALTVRASAASITPAPAPVQPWQGAAIKPLIASIATGVILWFSPVPAGVNRNAWQLLAIFLGTIVGIITQPLPLGAVAILGLGVSVLTKTLPFAAAFSGFGDPIPWLIALAFFFAKGFIKTGLGNRVAYQFVKLFGSSSLGLGYSLVFSEALLAPAIPSVSARAGGIFLPLVKALCVACGSNAGDGTEHRLGAWLMLTCFQTSVITSAMFLTAMAANPLCATLTQNSINQTIGWLDWAKAAIVPGLASLVLVPLILYVIYPPTLKSSPDAPKLAKEKLEKMGPMTTNEKIMTATLFLTVGLWVFGGLLNIDAVSAAILGLSVLLVTGVVTWKECLAEGVAWDTLTWFAALIAMAGYLNKYGLISWFSQTVVKFVGGLGLSWQLSFGILVLLYFYSHYFFASGAAHIGAMFTAFLSVATALGTPPFFGAIVLSFLSNLMGGLTHYGIGSAPVFFGANYVPLAKWWGYGFLISIVNIIIWLGLGGVWWKFIGLW

SEQ ID NO: 7394 - protein, 202 aa, Quercus alba
MGGTLLLTVGLWIFGGMLNVDAVTAAILGLSVLLVTGVVTWKECLAESVAWDTLTWFAALIAMAGYLNKYGLISWFSQTVVKFVGGLGLSWQLSFGILVLLYFYSHYFFASGAAHIGAMFTAFLSVASALGTPPYFGAMVLAFLSNLMGGLTHYGIGSAPVFYGANYVPLSKWWGYGFLISIVNIIIWLGVGGVWWKFIGLW

SEQ ID NO: 7395 - protein, 205 aa, Camellia sinensis
EIVMAGTLLLTVGLWVFGGVLNVDAVTAAILGLTVLLITGVVTWKECLAESVAWDTLTWFAALIAMAGYLNKYGLISWFSQTVVKFVGGLGLSWQLSFGILVLLYFYSHYFFASGAAHIGAMFTAFLSVASALGTPPYFGAMVLAFLSNLMGGLTHYGIGSAPVFYGANYVPLAKWWGYGFVISVVNIIIWLGVGGIWWKFIGLW

SEQ ID NO: 7396 - protein, 538 aa, Brachypodium distachyon
LPSFSLRRRSTLSSKPISLSHSHSLPKPLALPPSATARRHLLPPVSAASPASTPAPVSPPAKPALKGAAIKPLLASIATGLLIWFIPAPAGVARNAWQLLAVFLATIVGIITQPLPLGAVALLGLGAAVLTRTLTFAAAFSAFGDPIPWLIGRAFFFARGVHQDRARQPRRLRLRLRIRWIHARPRLLARLRRGRSSPPPNPPPVSRAGPAASSLPVVKSLCEACGSRTDDGTERKLGSWLMLTCFQTSVISSAMFLTAMAANPLAANLTASTIGQGIGWTLWAKAAIVPGLLSLIIVPLVLYVIYPPEVKSSPDAPRLAKEKLATMGPMSKEEIIMAGTLLLTVGLWIFGGMLSVDAVSAAILGLSVLLITGVVTWKECLAESVAWDTLTWFAALIAMAGYLNKYGLIAWFSETVVKFVGGLGLSWQLSFGVLVLLYFYSHYFFASGAAHIGAMFTAFLSVSSALGTPPLFAAMVLSFLSNIMGGLTHYGIGSAPVFYGAGYVPLAQWWGYGFVISVVNIIIWLGAGGFWWKMIGLW

SEQ ID NO: 7397 - protein, 552 aa, Arachis hypogaea
TTLPSLRLRSLSPKPKPLLHSLPTTSTTFKPLTLKPRSFNLITSISNAPFKSNRAHSTVVASVAGTASITSASPPPPPPQPWQGASMKPLLASIAIGVLVWYSPVPAGVSRNAWQLLAIFLGTIVGIITQPLPLGAVALLGLGVSVLTKTLPFPAAFSGFGDPIPWLICLAFFFAKGFIKTGLGNRVAYQFVSLFGSSSLGLGYSLVFSEALLAPAIPSVSARAGGIFLPLVKALCVACGSNAGDGTENRLGSWLMLTCFQTSVISSAMFLTAMAANPLCATLTQNAINKTIGWVDWAKAGIVPGLVSLVLVPLILYVIYPPGMKSSPDAPKLARERLQKMGPMTSHEKIMTLTLLLTVGLWVFGGVLNIDAVTAAILGLSVLLVTGVVTWKECLAEGVAWDTLTWFAALIAMAGYLNKYGLISWFSQTVVKFVGGLGLSWQLSFGILVLLYFYSHYFFASGAAHIGAMFTAFLSVATALGTPPFFGAMVLSFLSNLMGGLTHYGIGSAPVFYGANYVPLAKWWGYGFLISIVNIVIWLGLGGVWWKAIGLW

SEQ ID NO: 7398 - protein, 413 aa, Cichorium intybus
MGLGACVLTKTLTFAAAFSAFGDPIPWLIALAFFFARGFIKTGLGNRIAYQFVSLFGSSSLGLGYSLVFSEALLAPAIPSVSARAGGIFLPLVKSLCVACGSNVGDGTEHKLGSWLMLTCFQTSVISSSMFLTAMAANPLSANLTFNTIQQTIGWTDWAVAAIVPGIISLIVVPFILYIIYPPSVKSSPDAPKLAKERLEKMGPMTKNEIIMAGTLFLTVGLWIFGGMLGIDAVTAAILGLSVLLITGVVTWKECLAESVAWDTLTWFAALIAMAGYLNKYGLISWFSQTVVKFVGGLGLQWQASFGILVLLYFYSHYFFASGAAHIGAMFTAFLSVASALGTPPLFGAMVLAFLSNLMGGLTHYGIGSAPVFYGANYVPLGKWWGYGFLISVVNIIIWLGVGGVWWKFIGLW

SEQ ID NO: 7399 - protein, 579 aa, Vigna unguiculata
  misc_feature (1)..(1): Xaa can be any naturally occurring amino acid
XALLSSTTATSLDPTPTVMASVALTTTLPSLRLRRNTTAAAALKPNRLTSFPPSSLKPNLSTSISSFPNFSLKKPNLVLTRKHSSFTVRATVASVTPAPAPAPAPIQPWQGAAIKPLLASIATGVILWFTPVPAGVNRNAWQLLAIFLGTIVGIITQPLPLGAVAILGLGVSVLTKTLTFAAAFSGFGDPIPWLIALAFFFAKGFIKTGLGNRVAYQFVKLFGSSSLGLGYSLVFSEALLAPAIPSVSARAGGIFLPLVKALCVACGSNAGDGTEKKLGAWLMLTCFQTSVITSAMFLTAMAANPLCATLTQSSINQTIGWLDWAKAAIVPGLASLVLVPLILYVIYPPTLKSSPDAPKLAREKLEKMGPMTTNEKIMTATLFLTVGLWVFGGLLNIDAVSAAILGLSVLLVTGVVTWKECLGEGVAWDTLTWFAALIAMAGYLNKYGLIAWFSQTVVKFVGGLGLSWQLSFGILVLLYFYSHYFFASGAAHIGAMFTAFLSVSTALGTPPFFGAIVLSFLSNLMGGLTHYGIGSAPVFFGANYVPLAQWWGYGFLISIVNIIIWLGLGGVWWKFIGLW

SEQ ID NO: 7400 - protein, 329 aa, Helianthus annuus
AGGIFLPLVKSLCVACGSNAGDGTEHKLGAWLMLTCFQTSVISSSMFLTAMAANPLSANLTFNTIKQTIGWTDWAVAAIVPGIVSLIVVPLILYVVYPPSVKSSPDAPKLAKEKLEKMGPMTKNEVIMAGTLLLTVGLWIFGGMLNVDAVTAAILGLSVLLITGVVTWKECLAEAVAWDTLTWFAALIAMAGYLNKYGLISWFSQTVVKFVGGLGLQWQASFGILVLLYFYSHYFFASGAAHIGAMFTAFLSVASALGTPPLFGAMVLSFLSNLMGGLTHYGIGSAPVFYGANYVPLAKWWGYGFLISVVNIIIWLGVGGVWWKFIGLW

SEQ ID NO: 7401 - protein, 222 aa, Triphysaria pusilla
PKLAKEKLAAMGPMSKNEIIMAGTLLLTVGLWIFGSVLSVDAVTAAILGLSVLLVTGVVTWKECLAESVAWDTLTWFAALIAMAGYLNKYGLISWFSQTVVKFVGGLGLSWQLSFGILVFLYFYSHYFFASGAAHIGAMFTAFLSVASALGTPPYLGAVVLAFLSNLMGGITHYGIGSAPVFYGAGYVPLGKWWGYGFLISVVNLIIWLGVGGLWWKAIGLW

SEQ ID NO: 7402 - protein, 243 aa, Prunus persica
EAMAANPLSANLTFNTIKQTIGWTDWAKAAIVPGLVSLIVVPLLLYVIYPPEVKSSPDAPKLARERLEKMGPMSNKEIIMAGTLLLTVGLWIFGGVLNVDAVTAAILGLSVLLVTGVITWKECLAESVAWDTLTWFAALIAMAGYLNKYGLISWFSQTVVKFVGGLGLSWQLSFGILVLLYFYSHYFFASGAAHIGAMFTAFLSVASALGTPHTLERWCLHSSQPHGWPYPLWYWVGTCFLRR

SEQ ID NO: 7403 - protein, 248 aa, Helianthus annuus
GIVSLIVVPLILYVVYPPSVKSSPDAPKLAKEKLEKMGPMTKNEVIMAGTLLLTVGLWIFGGMLNVDAVTAAILGLSVLLITGVVTWKECLAEAVAWDTLTWFAALIAMAGYLNKYGLISWFSQTVVKFVGGLGLQWQASFGILVLLYFYSHYFFASGAAHIGAMFTAFLSVASALGTPPLFGAMVLSFLSNLMGGLTHYGIGSAPVFYGANYVPLAKWWGYGFLISVVNIIIWLGVGGVWWKSLACG

SEQ ID NO: 7404 - protein, 222 aa, Triphysaria pusilla
  misc_feature (114)..(114): Xaa can be any naturally occurring amino acid
PKLAKEKLAAMGPMSKNEIIMAGTLLLTVGLWIFGSVLSVDAVTAAILGLSVLLVTGVVTWKECLAESVAWDTLTWFAALIAMAGYLNKYGLISWFSQTVVKFVGGLGLSWQLXFGILVFLYFYSHYFFASGAAHIGAMFTAFLSVASALGTPPYLGAVVLAFLSNLMGGITHYGIGSAPVFYGAGYVPLGKWWGYGFLISVVNLIIWLGVGGLWWKAIGLW

SEQ ID NO: 7405 - protein, 555 aa, Solanum lycopersicum
MASLALTSAVNLRLRPTPSQKPRISITQSLHFTQTSLKSTNLGKSLNLGGKRLNLEKSRRVIVKASASASASSSPAIVPQQQPPWQGAAMKPLIASIATGVILWFIPAPAGVTKNAWQLLAIFLATIVGIITQPLPLGAVALMGLGACVLTKTLTFAAAFSAFGDPIPWLIALAFFFARGFIKTGLGNRIAYQFVKLFGSSSLGLGYSLVFSEALLAPAIPSVSARAGGIFLPLVKSLCVACGSNAGDGTEHKLGSWLMLTCFQTSVISSSMFLTAMAANPLSANLTLSTINQTIGWMDWAKAAIVPGLVSLIVVPLLLYIIYPPTVKSSPDAPRLAKERLEKMGPMSKNEIIMAVTLLLTVGLWVFGGALKVDAVTAAILGLSVLLVTGVVTWKECLGEAVAWDTLTWFAALIAMAGYLNKYGLISWFSETVVKVVGGLGLSWQLSFGILVLLYFYSHYFFASGAAHIGAMFTAFLSVASALGTPPYLGALVLSFLSNLMGGITHYGIGSAPVFYGANYVPLAKWWGYGFVCSVVNLLIWLGVGGIWWKAIGLW

SEQ ID NO: 7406 - protein, 560 aa, Panicum virgatum
MASSTAASPLTCHHLGASAAPRSRLPALSFSLRRRSSKPISLSHSHSLPSKPLFAPPPAASASPSPSRGALQPASASAAAAPAPPPKPALQGAAIKPLLATIATGVLIWLVPAPAGVPRNAWQLLAIFLSTIVGIITQPLPLGAVALLGLGAAVLTRTLTFAAAFSAFGDPIPWLIALAFFFARGFIKTGLGSRVAYAFVAQFGSSSLGLGYALVFAEALLAPAIPSVSARAGGIFLPLVKSLCEACGSRSGDGTERRLGAWLMLTCFQTSVVSSAMFLTAMAANPLSANLTAATIGEGIGWTLWAKAAIVPGLLSLVLVPLILYVIYPPEVKSSPDAPRLAKERLAKMGPMSKAETIMAGTLLLTVGLWIFGGMLNVDAVSAAILGLSVLLITGVVTWKECLAESVAWDTLTWFAALIAMAGYLNKYGLISWFSETVVKFVGGLGLSWQLSFGVLVLLYFYSHYFFASGAAHIGAMFAAFLSVASALGTPSLFAAMVLSFLSNLMGGLTHYGIGSAPVFYGAGYVPLAQWWGYGFVISVVNILIWLGAGGFWWKMIGLW

SEQ ID NO: 7407 - protein, 308 aa, Cajanus cajan
GGDGEQVGGVADAYLFSDFGDYVGDVLTAMAANPLCATLTLNSINQTIGWLDWAKAAIVPGLASLVLVPLILYVIYPPTLKNSPDAPKLAKEKLETMGPMTAHEKIMTATLFLTVGLWVFGGLLNIDAVSAAILGLAVLLVTGVVTWKECLAEGVAWDTLTWFAALIAMAGYLNKYGLISWFSQTVVKFVGGLGLSWQLSFGILVLLYFYSHYFFASGAAHIGAMFTAFLSVATALGTPPFFGAIVLSFLSNLMGGLTHYGIGSAPVFFGANYVPLAKWWGYGFVISIVNIIIWLGLGGVWWKFIGLW

SEQ ID NO: 7408 - protein, 562 aa, Helianthus annuus
  misc_feature (107)..(107): Xaa can be any naturally occurring amino acid
  misc_feature (528)..(528): Xaa can be any naturally occurring amino acid
  misc_feature (544)..(544): Xaa can be any naturally occurring amino acid
  misc_feature (548)..(548): Xaa can be any naturally occurring amino acid
  misc_feature (553)..(553): Xaa can be any naturally occurring amino acid
  misc_feature (562)..(562): Xaa can be any naturally occurring amino acid
MASLALTTSVNLGFRSPTTVNHRLSTKQSPAFNLHRSNGPHHLRLPSLKLKSPIRNPNFTVKASAAAVPAKPDAPAPAPVPWQGAAMKPLIASIATGVILWFVPVPXGVSKNAWQLLAIFLATIVGIITQPLPLGAVALLGLGACVLTKTLTFAAAFSAFGDPIPWLIALAFFFARGFIKTGLGNRIAYQFVKLFGSSSLGLGYSLVFSEALLAPAIPSVSARAGGIFLPLVKSLCVACGSNVGDGTEHKLGSWLMLTCFQTSVISSSMFLTAMAANPLSANLTFNTIKQTIGWTDWAVAAIVPGIVSLIVVPLILYVIYPPTVKSSPDAPKLAKEKLEKMGPMTKNEIIMAGTLLLTVGLWIFGGMLNVDAVTAAILGLSVLLITGVVTWKECLGEAVAWDTLTWFAALIAMAGYLNKYGLISWFSQTVVKFVGGLGLQWQASFGILVLLYFYSHYFFASGAAHIGAMFTAFLSVASALGTPPLFGAMVLAFLSNLMGGLTHYGIGSAPVFYGANYVPLAKWWGYGXLISVVNIIIWLGVGGXWWKXIGLWXTKGSTDLLX

SEQ ID NO: 7409 - protein, 560 aa, Triphysaria pusilla
MAFSALTSSVNLRAAPLSTLKSRRPSSTANKPHHVTPIFRCLANKSHINLNNPRINDSIPFANPNLLPAPKRSLITAASASSPPATQQPWQGASMKPLIASIATGVILWFIPAPDGVSRVAWQLLSIFLATIVGIITQPLPLGAVALMGLGACVLTKTLTFAAAFSAFGDPIPWLIALAFFFARGFIKTGLGNRIAYQFVSLFGSSSLGLGYSLVFSEALLAPAIPSVSARAGGIFLPLVKSLCVACGSNVGDGTEHKLGSWLMLTCFQTSVISSSMFLTAMAANPLAANLTLSTINMQLGWMDWAKAAIVPGLVSLIVVPFLLYIIYPPSVKTSPDAPKLAKEKLEKMGPMSKNEIIMAVTLFLTVGLWIFGSVLSVDAVTAAILGLSVLLISGVVTWKECLAESVAWDTLTWFAALIAMAGYLNKYGLISWFSQSVVQFVGGLGLSWQLSFGILVLLYFYSHYFFASGAAHIGAMFTAFLSVASALGTPPYLAACVLAFLSNLMGGITHYGIGSAPVFYGAGYVPLAKWWGYGFVISIVNLVIWLGIGGIWWKAIGLW

SEQ ID NO: 7410 - protein, 236 aa, Triphysaria pusilla
YIIYPPSVKTSPDAPKLAKEKLEKMGPMSKNEIIMAVTLFLTVGLWIFGSVLSVDAVTAAILGLSVLLISGVVTWKECLAESVAWDTLTWFAALIAMAGYLNKYGLISWFSQSVVQFVGGLGLSWQLSFGILVLLYFYSHYFFASGAAHIGAMFTAFLSVASALGTPPYLAACVLAFLSNLMGGITHYGIGSAPVFYGAGYVPLAKWWGYGFVISIVNLVIWLGIGGIWWKAIGLW

SEQ ID NO: 7411 - protein, 247 aa, Mimulus guttatus
LVSLIVVPFLLYIIYPPTVKSSPDAPKLAKEKLEKMGPMSKNEIIMAGTLLLTVGLWISGSVLNVDAVTAAILGLSVLLITGVVTWKECLAESVAWDTLTWFAALIAMAGYLNKYGLISWFSQTVVQFVGGLGLSWQLSFGVLVLLYFYSHYFFASGAAHIGAMFTAFLSVATALGTPPYLGACVLAFVSNLMGGITHYGIGSAPVFYGAGYVPLGKWWGYGFLISIVNLVIWLGVGGLWWKAIGLW

SEQ ID NO: 7412 - protein, 466 aa, Mimulus guttatus
MKPLIASIATGVILWFLPAPEGVSRVAWQLLSIFLATIVGIITQPLPLGAVALMGLGACVLTKTLTFAAAFSAFGDPIPWLIALAFFFARGFIKTGLGNRIAYQFVSLFGSSSLGLGYSLVFSEALLAPAIPSVSARAGGIFLPLVKSLCVACGSNVGDGTEEKLGSWLMLTCFQTSVISSAMFLTGMAANPLAANLTLSTINMSIGWMDWAKAAIVPGLVSLIVVPFLLYIIYPPTVKSSPDAPKLAKEKLEKMGPMSKNEIIMAGTLLLTVGLWISGSVLNVDAVTAAILGLSVLLITGVVTWKECLAESVAWDTLTWFAALIAMAGYLNKYGLISWFSQTVVQFVGGLGLSWQLSFGVLVLLYFYSHYFFASGAAHIGAMFTAFLSVATALGTPPYLGACVLAFVSNLMGGITHYGIGSAPVFYGAGYVPLGKWWGYGFLISIVNLVIWLGVGGLWWKAIGLW

SEQ ID NO: 7413 - protein, 239 aa, Acacia harpophylla
LILYVIYPPTVKASPDAPKLAREKLQQMGPMTTAEKTMAITLFLTVGLWIFGGALKVDAVSAAILGLSVLLVTGVVTWKECLAEGVAWDTLTWFAALIAMAGYLNKYGLISWFSQTVVKFVGGLGLSWQLSFGILVLLYFYSHYFFASGAAHIGAMFTAFLSVASALSTPPFFGAIVLSFLSNLMGGLTHYGIGSAPVFFGASYVPLAKWWGYGFLISIVNIIIWLGVGGVWWKAIGLW

SEQ ID NO: 7414 - protein, 310 aa, Solanum tuberosum
MASLALTSAVNLRLRPTPSQKPRISITQSLHFTQTSLKTTNLGKSLNLGGKRLNLEKSRRVIVKTSASASASSPAIVPQQQPPWQGAAMKPLIASIATGVILWFIPAPAGVTKNAWQLLAIFLATIVGIITQPLPLGAVALMGLGACVLTKTLTFAAAFSAFGDPIPWLIALAFFFARGFIKTGLGNRIAYQFVKLFGSSSLGLGYSLVFSEALLAPAIPSVSARAGGIFLPLVKSLCVACGSNAGDGTEHKLGSWLMLTCFQTSVISSSMFLTAMAANPLSANLTLSTINQTIGWMDWAKAAIVPGLVS

SEQ ID NO: 7415 - protein, 328 aa, Solanum tuberosum
MASLALTSAVNLRLRPTPSQKPRISITQSLHFTQTSLKTTNLGKSLNLGGKRLNLEKSRRVIVKTSASASASSPAIVPQQQPPWQGAAMKPLIASIATGVILWFIPAPAGVTKNAWQLLAIFLATIVGIITQPLPLGAVALMGLGACVLTKTLTFAAAFSAFGDPIPWLIALAFFFARGFIKTGLGNRIAYQFVKLFGSSSLGLGYSLVFSEALLAPAIPSVSARAGGIFLPLVKSLCVACGSNAGDGTEHKLGSWLMLTCFQTSVISSSMFLTAMAANPLSANLTLSTINQTIGWMDWAKAAIVPGFGVFNCGSIVVVHHLSTYSEE

SEQ ID NO: 7416 - protein, 207 aa, Solanum lycopersicum
  misc_feature (86)..(88): Xaa can be any naturally occurring amino acid
KNEIIMAVTLLLTVGLWVFGGALKVDAVTAAILGLSVLLVTGVVTWKECLGEAVAWDTLTWFAALIAMAGYLNKYGLISWFSETVXXXVGGLGLSWQLSFGILVLLYFYSHYFFASGAAHIGAMFTAFLSVASALGTPPYLGALVLSFLSNLMGGITHYGIGSAPVFYGANYVPLAKWWGYGFVCSVVNLLIWLGVGGIWWKAIGLW

SEQ ID NO: 7417 - protein, 195 aa, Senecio madagascariensis
GSPGLQVGGMLGVDAVTAAILGLSVLLITGVVTWKECLGESVAWDTLTWFAALIAMAGYLNKYGLISWFSQTVVKFVGGLGLQWQASFGILVLLYFYSHYFFASGAAHIGAMFTAFLSVASALGTPPLFAAMVLAFLSNLMGGLTHYGIGSAPVFYGANYVPLGKWWGYGFLISVVNIIIWLGVGGVWWKFIGLW

SEQ ID NO: 7418 - protein, 548 aa, Oryza sativa
MATSTSAATAPLTCHHLGLRLRPRLPSLPLRPLSPSPSLSLSRPTPLTPSPPPRHRALHASASAAPAAPPSQPPKPVLQGAAIKPLVATIGTGVLIWLVPPPAGVARNAWQLLSIFLATIVGIITQPLPLGAVALLGLGAAVLTRTLTFAAAFSAFGDPIPWLIALAFFFARGFIKTGLGSRVAYAFVSAFGGSSLGLGYALVFAEALLAPAIPSVSARAGGIFLPLVKSLCEACGSRAGDGTERRLGSWLMLTCFQTSVISSAMFLTAMAANPLAANLTAGTIGQGIGWTLWAKAAIVPGLLSLVFVPLILYLIYPPEVKTSPDAPRLAKERLEKMGPMSKEEKIMAGTLFLTVGLWIFGGMLNVDAVSAAILGLSVLLISGVVTWKECLGEAVAWDTLTWFAALIAMAGYLNKYGLISWFSETVVKFVGGLGLSWQLSFGVLVLLYFYSHYFFASGAAHIGAMFTAFLSVSSALGTPPLIAAMVLSFLSNIMGGLTHYGIGSAPVFYGAGYVPLAQWWGYGFVISIVNIIIWLGAGGFWWKMLGLW

SEQ ID NO: 7419 - protein, 589 aa, Pinus taeda
MASAALAASSTVGIRAPHISTVQRNHHHHRSPPLSSIALAAAPARPFLQLRDSISRSHAAAGRSSLVSSWWGRQQQIQEQKRPLFAPLDGLRPRRKAPPVASPRASSAAVTPAPPPQPWQGAALKPLAASIATGVILWLVPAPAGVAKNAWQLLAIFLATIVGIITQPLPLGAVALMGLGAAVLTKTLTFAAAFSAFGDQIPWLIALAFFFARGFIKTGLGNRVAYQFVALFGSSSLGLGYSLVFSEALLAPAIPSVSARAGGIFLPLVKSLCVACGSNVGDGTERRLGSWLMLTCFQTSVISSAMFLTAMAANPLSVNLAAGAIGQTIGWTDWAVAALVPGLVSLIVVPLLLYVIYPPSVKSSPDAPKLAKEKLAKMGPMTKNETIMSATLLVTVGLWIFGGMLKVDAVTAAILGLSVLLCTGVVTWKECLAESVAWDTLTWFAALIAMAGYLNKYGLISWFSQTVVKVVGGLGLSWQLSFGILVLLYFYSHYFFASGAAHIGAMFTAFLSVASALGTPPLFGAMVLSFLSNLMGGLTHYGIGSAPVFYGANYVPLAEWWGYGLLISVVNIVIWLGLGGVWWKFLGLW

SEQ ID NO: 7420 - protein, 396 aa, Artemisia annua
  misc_feature (14)..(14): Xaa can be any naturally occurring amino acid
  misc_feature (184)..(184): Xaa can be any naturally occurring amino acid
FSAFGDPIPWLIAXAFFFARGFIKTGLGNRIAYQFVKLFGSSSLGLGYSLVFSEALLAPAIPSVSARAGGIFLPLVKSLCVACGSNVGDGTEGKLGSWLMLTCFQTSVISSSMFLTAMAANPLSVNLTFNTIKQTIGWTDWAVAAIVPGLVSLIVVPLILYIIYPPSVKSSPDAPKLAKEKLEXMGPMTKNEIIMGGTLLLTVGLWIFGGMLGIDAVTAAILGLSVLLITGVVTWKECLGEAVAWDTLTWFAALIAMAGYLNKYGLISWFSETVVKFVGGLGLQWQASFGILVLLYFYSHYFFASGAAHIGAMFTAFLSVASALGTPPLFAAMVLAFLSNLMGGLTHYGIGSAPVFYGANYVPLGKWWGYGFIISVVNIIIWLGVGGVWWKFIGLW

SEQ ID NO: 7421 - protein, 334 aa, Ocimum basilicum
SVSARAGGIFLPLVKSLCVACGSNAGDGTEHKLGSWLMLTCFQTSVISSSMFLTAMAANPLAANLTASTINMSIGWMDWAKAAIVPGLVSLIVVPLLLYIIYPPSVKSSPDAPKLAREKLEKMGPLSKSEIIMAGTLLLTVGLWIFGGVLKVDAVTAAILGLSVLLATGVVTWKECLAESVAWDTLTWFAALIAMAGYLNKYGLISWFSQTVVKFVGGLGLSWQLSFGILVLLYFYSHYFFASGAAHIGAMFTAFLSVASALGTPPYLGAVVLSFLSNLMGGITHYGIGSAPVFYGAGYVPLAKWWGYGFFISVVNLIVWLGVGGVWWKAIGLW

SEQ ID NO: 7422 - protein, 480 aa, Pisum sativum
PAPVPAVPWQGAAIKPLLASIATGVIIWFLPTPEGVSRNAWQLLAIFLGTIVGIITQPLPLGAVAILGLGVSVLTKTLPFVAAFSGFGDPIPWLICLAFFFAKGFIKTGLGNRVAYQFVSLFGSSSLGLGYSLVFSEALLAPAIPSVSARAGGIFLPLVKSLCVACGSNVGDGTENKLGSWLMLTCFQTSCISSAMFLTAMAANPLCATLTLNSINQTIGWLDWGKSCYCAWFWCRWFWVPLILYIIYPPTMKSSPDAPKLARERLAKMGPMSANEKIMTATLFLTVGLWVFGGLLNVDAVTSAILGLAVLLITGVVTCKECLAEGVAWDTLTWFAALIAMAGYLNKYGLISWFSQTVVKFVGGLGLSWQLSFGILVLLYFYSHYFFASGAAHIGAMFTAFLSVATALGTPPFFGAMVLSFLSNLMGGLTHYGIGSAPVFFGANYVPLAKWWGYGFVISIVNIIIWLGLGSIWWKAIGLW

SEQ ID NO: 7423 - protein, 554 aa, Solanum phureja
MASLALTSAVNLRLRPTPSQKPRISITQSLHFTQTSLKTTNLGKSLNLGGKRLNHEKSRRVIVKTSASASASSPAIVPQQQPPWQGAAMKPLIASIATGVILWFIPAPAGVTKNAWQLLAIFLATIVGIITQPLPLGAVALMGLGACVLTKTLTFAAAFSAFGDPIPWLIALAFFFARGFIKTGLGNRIAYQFVKLFGSSSLGLGYSLVFSEALLAPAIPSVSARAGGIFLPLVKSLCVACGSNAGDGTEHKLGSWLMLTCFQTSVISSSMFLTAMAANPLSANLTLSTINQTIGWMDWAKAAIVPGLVSLIVVPLLLYIIYPPTVKSSPDAPRLAKERLEQMGPMSKNEIIMAGTLLLTVGLWVFGGALKVDAVTAAILGLSVLLVTGVVTWKECLGEAVAWDTLTWFAALIAMAGYLNKYGLISWFSETVVKVVGGLSLSWQLSFGILVLLYFYSHYFFASGAAHIGAMFTAFLSVASALGTPPYLGALVLSFLSNLMGGITHYGIGSAPVFYGANYVPLAKWWGYGFVCSVVNLIIWLGVGGIWWKAIGLW

SEQ ID NO: 7424 - protein, 220 aa, Heritiera littoralis
LAKEKLEKMGPMSKNEIIMAGTLLLTVGPWIFGGSLNVDTVTAAILGLSVLLVTGVVTWKECLAESVAWDTLTWFAALIAMAGYLNKYGLISWFSETVVKVVGGLGLSWQLSFGILVLLYFYSHYFFASGAAHIGAMFTAFLSVASALGTPPYLGALVLSFLSNLVGGITHYGIGSAPVFYGAGYVPLAKWWGYGFLISIINIIIWLGVGGIWWKAIGLW

SEQ ID NO: 7425 - protein, 327 aa, Adiantum capillus-veneris
GIFLPLVKSLCIACGSRVGDGTEEKLGSWLMLTCFQTSVISSAMFLTGMAANPLSVNLIAGAIGQTIGWTDWAVAAFVPGLVSLLVVPLLLYVIYPPTVKNSPDAPKLAKEKLEAMGPMSKNEIIMSATLLVTVGLWVFGGAIKVDAVTAAIMGLSVLLISGVVTWKECLGEAVAWDTLTWFAALIAMAGYLNKYGLIAWFSQTVVKVVGGLGLAWQPAFGILVLLYFYSHYFFASGAAHIGAMLTAFLSVATALGTPPLFGALVLSFLSNIMGGLTHYGIGSAPVFYGANYVPLSKWWGYGFLISIVNIVIWLGLGGVWWKVLGLW

SEQ ID NO: 7426 - protein, 200 aa, Fragaria vesca
GTLFLTVGLWIFGGMIGVDAVTAAILGLSVLLVTGVVTWKECLAESVAWDTLTWFAALIAMAGYLNKYGLISWFSETVVKFVGGLGLGWQPAFGILVLLYFYSHYFFASGAAHIGAMFTAFLSVASALGTPPYFAAMVLSFLSNLMGGLTHYGIGSAPVFYGAGYVPLAQWWGYGFLMSVVNIIIWLGVGGVWWKFIGLW

SEQ ID NO: 7427 - protein, 344 aa, Arachis hypogaea
GEALLAPAIPSVSARAGGIFLPLVKSLCAACGSNPGDGTERRLGAWLSLTCFQTSVISSAMFLTGMAANPLCANLTQSSINQTIGWLDWARAAIVPGLVSLVLVPLILYIIYPPTLKSSPDAPKLARQKLQSMGPMSSNEKIMTATLLLTVGLWVFGGVLNIDAVTAAILGLAVLLVSGVVTWKECLGEGVAWDTLTWFAALIAMAAYLNKYGLIAWFSQTVVKFVGGLGLSWQLSFGILVLLYFYSHYFFASGAAHIGAMFTAFLSVATALGTPPFFGAMVLSFLSNLMGGLTHYGIGSAPVFYGANYVPLAQWWGYGLLISIVNIFIWLGLGGVWWKVIGLW

SEQ ID NO: 7428 - protein, 326 aa, Arachis hypogaea
IFLPLVKSLCAACGSNPGDGTERRLGAWLSLTCFQTSVISSAMFLTGMAANPLCANLTQSSINQTIGWLDWARAAIVPGLVSLVLVPLILYIIYPPTLKSSPDAPKLARQKLQSMGPMSSNEKIMTATLLLTVGLWVFGGVLNIDAVTAAILGLAVLLVSGVVTWKECLGEGVAWDTLTWFAALIAMAAYLNKYGLIAWFSQTVVKFVGGLGLSWQLSFGILVLLYFYSHYFFASGAAHIGAMFTAFLSVATALGTPPFFGAMVLSFLSNLMGGLTHYGIGSAPVFYGANYVPLAQWWGYGLLISIVNIFIWLGLGGVWWKVIGLW

SEQ ID NO: 7429 - protein, 560 aa, Avena sativa
MASSASAASPLTCHHLGVRLRPHLSSFSLRRRSTSSLSSKPISLSHSHSHPLPKPLTLSPAATARRLLPPVGAAPTSSPAPVSPPAKPALQGAAIKPLLASIATGVIIWLIPAPAGVARNAWQLLAVFLATIVGIITQPLPLGAVALLGLGAAVLTRTLTFAAAFSAFGDPIPWLIALAFFFARGFIKTGLGNRVAYAFVSAFGGSTLGLGYSLVFAEAFLAPAIPSVSARAGGIFLPLVKSLCEACGSRTDDGTERKLGAWLMLTCFQTSVISSAMFLTAMAANPLAANLTASTIGQGIGWTLWAKAAIVPGLLSLVLVPLVLYVIYPPEVKTSPDAPRLAKERLAKMGPMSKEEKIMGGTLLLTVGLWIFGGMLSVDAVSAAILGLSVLLITGVVTWKECLAESVAWDTLTWFAALIAMAGYLNKYGLIAWFSETVVKFVGGLGLSWQLSFGVLVLLYFYSHYFFASGAAHIGAMFTAFLSVSSALGTPPLIAAMVLSFLSNLMGGLTHYGIGSAPVFYGAGYVPLAQWWGYGFVISVVNIIIWLGAGGFWWKMLGLW

SEQ ID NO: 7430 - protein, 272 aa, Pennisetum glaucum
ANLTAATIGEGIGWTLWAKAAIVPGLLSLVLVPLILYVIYPPEVKSSPDAPRLAKERLAKMGPMSTPEKIMAGTLLLTVGLWIFGGMINVDAVSAAILGLGVLLITGVVTWKECLAESVAWDTLTWFAALIAMAGYLNKYGLISWFSETVVKFVGGLGLSWQLSFSVLVLLYFYSHYFFASGAAHIGAMFAAFLSVAKALGTPSLFAAMVLSFLSNLMGGITHYGIGSAPVFYGAGYVPLAQWWGYGFVISVVNIIIWLGVGGFWWKMIGLW

SEQ ID NO: 7431 - protein, 190 aa, Brachypodium distachyon
VGLWIFGGMLSVDAVSAAILGLSVLLITGVVTWKECLAESVAWDTLTWFAALIAMAGYLNKYGLIAWFSETVVKFVGGLGLSWQLSFGVLVLLYFYSHYFFASGAAHIGAMFTAFLSVSSALGTPPLFAAMVLSFLSNIMGGLTHYGIGSAPVFYGAGYSPPGSVVGAMDLSSPLLTSSSGLVPEASGGR

SEQ ID NO: 7432 - protein, 188 aa, Ipomoea nil
  misc_feature (14)..(14): Xaa can be any naturally occurring amino acid
GSKLNVDAVTAAIXGLSVLLVTGVVTWKECLAEAVAWDTLTWFAALIAMAGYLNKYGLISWFSETVVKVVGGLGLSWQLSFGILVLLYFYSHYFFASGAAHIGAMFTAFLSVASALGTPPYLGALVLAFLSNIMGGLTHYGIGSAPVFYGANYVPLAKWWGYGFLISVVNIIIWLGVGGIWWKAIGLW

SEQ ID NO: 7433 - protein, 193 aa, Capsicum annuum
GLWVFGGTLKVDAVTAAILGLSVLLVTGVVTWKECLGEAVAWDTLTWFAALIAMAGYLNKYGLISWFSETVVKVVGGLGLSWQLSFGILVLLYFYSHYFFASGAAHIGAMFTAFLSVASALGTPPYLGALVLSFLSNLMGGITHYGIGSAPVFYGANYVPLAKWWGYGFVCSIVNLIIWLGVGGIWWKAIGLW

SEQ ID NO: 7434 - protein, 395 aa, Hordeum vulgare
SAFGDPIPWLIALAFFFARGFIKTGLGNRVAYQFVSAFGGSTLGLGYSLVFAEAFLAPAIPSVSARAGGIFLPLVKSLCEACGSRTDDGTERKLGAWLMLTCFQTSVISSAMFLTAMAANPLAANLTLSTIGQGIGWTLWAKAAIVPGLLSLLIVPLVLYLIYPPEVKTSPDAPRLAKERLAKMGPMSTEEKIMAGTLLLTVGLWIFGGMLSVDAVSAAILGLSVLLITGVVTWKECLAESVAWDTLTWFAALIAMAGYLNKYGLISWFSETVVKFVGGLGLSWQLSFGVLVLMYFYSHYFFASGAAHIGAMFTAFLSVASALGTPPLFAAMVMSFLSNLMGGLTHYGIGSAPVFYGAGYVPLAEWWGYGFVISVVNIIIWLGAGGFWWKMIGLW

SEQ ID NO: 7435 - protein, 394 aa, Hordeum vulgare
AFGDPIPWLIALAFFFARGFIKTGLGNRVAYQFVSAFGGSTLGLGYSLVFAEAFLAPAIPSVSARAGGIFLPLVKSLCEACGSRTDDGTERKLGAWLMLTCFQTSVISSAMFLTAMAANPLAANLTLSTIGQGIGWTLWAKAAIVPGLLSLLIVPLVLYLIYPPEVKTSPDAPRLAKERLAKMGPMSTEEKIMAGTLLLTVGLWIFGGMLSVDAVSAAILGLSVLLITGVVTWKECLAESVAWDTLTWFAALIAMAGYLNKYGLISWFSETVVKFVGGLGLSWQLSFGVLVLMYFYSHYFFASGAAHIGAMFTAFLSVASALGTPPLFAAMVMSFLSNLMGGLTHYGIGSAPVFYGAGYVPLAEWWGYGFVISVVNIIIWLGAGGFWWKMIGLW

SEQ ID NO: 7436 - protein, 357 aa, Triticum aestivum
GGSTLGLGYSLVFAEAFLAPAIPSVSARAGGIFLPLVKSLCEACGSRTDDGTERKLGAWLMLTCFQTSVISSAMFLTAMAANPLAANLTLSTIGQGIGWTLWAKAAIVPGLLSLLIVPLVLYVIYPPEVKTSPDAPRLAKERLAKMGPMSTEEKIMAGTLLLTVGLWIFGGMLSVDAVSAAILGLSVLLITGVVTWKECLAESVAWDTLTWFAALIAMAGYLNKYGLISWFSETVVKFVGGLGLSWQLSFGVLVLMYFYSHYFFASGAAHIGAMFTAFLSVASALGTPPLFAAMVMSFLSNLMGGLTHYGIGSAPVFYGAGYVPLAEWWGYGFVISVVNIIIWLGAGGFWWKMIGLW

SEQ ID NO: 7437 - protein, 258 aa, Selaginella moellendorffii
TDWAVAAVVPGLVSLLVVPLLLYVIYPPTVKSSPDAPRLAREKLDKMGPMSKNEWIMTGTLIVTVGLWIFGSAIKVDAVTAAILGLSVLLTTGVVTWKECLGEAVAWDTLTWFAALIAMAGYLNKYGLIAWFSQTVVKVVGGLGLSWQASFGILVMLYFYSHYFFASGAAHIGAMFTAFLSVSTALGTPPLFGALVLAFLSNLMGGLTHYGIGSAPVFYGAGYVPLSTWWGYGFLMSVVNLVIWLGVGGFWWKLLGLW

SEQ ID NO: 7438 - protein, 220 aa, Triticum aestivum
  misc_feature (6)..(6): Xaa can be any naturally occurring amino acid
  misc_feature (23)..(24): Xaa can be any naturally occurring amino acid
  misc_feature (52)..(52): Xaa can be any naturally occurring amino acid
LAKERXAKMGPMSTEEKIMAGTXXLTVGLWIFGGMLSVDAVSAAILGLSVLXITGVVTWKECLAESVAWDTLTWFAALIAMAGYLNKYGLISWFSETVVKFVGGLGLSWQLSFGVLVLMYFYSHYFFASGAAHIGAMFTAFLSVASALGTPPLFAAMVMSFLSNLMGGLTHYGIGSAPVFYGAGYVPLAEWWGYGFVISVVNIIIWLGAGGFWWKMIGLW

SEQ ID NO: 7439 - protein, 582 aa, Physcomitrella patens
MACMAAAVSNGVRLSPVASPRGVAPRGVSCSARSLGVRGAFGLRSRGGIRSLGLAASSSESGFLVGDGLLKGIAALPALRKSDGEARLGVRADAGAGVVPAATPAPKKEEPWMGASMKPLIASIAVGVLVWFIPTPVGVTKNAWQLLSIFLATVVGIITQPLPLGAVALMGLGASVLTKTLTFAAAFSAFGDPIPWLIALAFFFAKGFIKTGLGNRVAYQFVKLFGKTTLGLGYSLVFAEALLSPAIPSVSARSGGIFLPLVKALCLACGSKVGDGTERKLGSWLMLTCFQTSVITSAMFLTAMAANPLSVNLATGAIGQTISWTDWAVAASVPGLVSLLVIPALLYVVYPPEVKSSPDAPKLAAENLEKMGPMSKNEKIMSVTLIATVGLWIFGGVLGVDAVSAAILGLSVLLTTGVVTWKECLGESVAWDTLTWFAALIAMAGYLNKYGLIAWFSQNVVNVVGGLGLAWQASFGILVLLYFYSHYFFASGAAHIGAMFTAFLSVGTALGTPPLFGALVLAFLSNLMGGLTHYGIGSAPVFYGAGYVPLSQWWGYGFLCSVVNLVIWLGVGGVWWKFLGLL

SEQ ID NO: 7440 - protein, 205 aa, Cynara scolymus
  misc_feature (6)..(6): Xaa can be any naturally occurring amino acid
  misc_feature (10)..(11): Xaa can be any naturally occurring amino acid
  misc_feature (22)..(22): Xaa can be any naturally occurring amino acid
  misc_feature (27)..(27): Xaa can be any naturally occurring amino acid
IISSWXDSAXXVGLWIFGGMLXIDAVXAAILGLSVLLITGVVTWKECLGESVAWDTLTWFAALIAMAGYLNKYGLISWFSQTVVKFVGGLGLQWQASFGILVLLYFYSHYFFASGAAHIGAMFTAFLSVASALGTPPLFGAMVLAFLSNLMGGLTHYGIGSAPVFYGANYVPLAKWWGYGFIISVVNIIIWLGIGGIWWKFIGLW

SEQ ID NO: 7441 - protein, 198 aa, Ipomoea nil
LLITVGLWVFGSVLNIDAVTAAILGLTILLVTGVVSWKECLSEAVAWDTLTWFAALIAMAGYLNKYGLISWFSETVVKVVGGLGLSWQLSFGILVLLYFYSHYFFASGAAHIGAMFTAFLSVASALGTPPYLGALVLSFLSNIMGGLTHYGIGSAPVFYGANYVPLAKWWGYGFLVSVVNIIIWLGVGGIWWKAIGLW

SEQ ID NO: 7442 - protein, 578 aa, Zea mays
MASSTAASPLTCHHLGSVGARPRLPSLSISLRRRSSSSSKPTSLSHSLPSKHSLAPPPAASASSRRGLTPVPASASAAAAPAPDPVPVPAPAPAPAPAPAAPPKKPALQGAAIKPLLASIATGVLIWLIPPPAGVPRNAWQLLAIFLSTIVGIITQPLPLGAVALLGLGAAVLSRTLTFAAAFSAFGDPIPWLIALAFFFARGFIKTGLGSRVAYAFVAAFGSSSLGLGYSLVFAEALLAPAIPSVSARAGGIFLPLVKSLCEACGSRAGDGTERRLGAWLMLTCFQTSVVSSAMFLTAMAANPLSANLTAATIGEGIGWTLWAKAAIVPGLLSLVLVPLILYVIYPPEVKASPDAPRLAKERLAKMGPMSKEETIMAGTLLLTVGLWIFGGMLNVDAVSAAILGLAVLLISGVVTWKECLAESVAWDTLTWFAALIAMAGYLNKFGLISWFSETVVKFVGGLGMSWQLSFGVLVLLYFYSHYFFASGAAHIGAMFTAFLSVASALGTPSLFAAMVLSFLSNLMGGTTHYGIGSAPVFYGAGYVPLAQWWGYGFVISVVNIIIWLGVGGFWWKIIGLW

SEQ ID NO: 7443 - protein, 584 aa, Sorghum bicolor
MASSTAASPLTCHHLGSVGARPSLPSLSFGPLRRRSSSKPISLSHSLPSKPSSLAPPPAASSSASASSSSRRGLTPVSASASAAAAPAPDPVPAPAPAPAPAPAPAAPPKKPALQGAAIKPLLASLAIGVLIWFLPAPAGVPRNAWQLLAIFLSTIVGIITQPLPLGAVALLGLGAAVLTKTLTFAAAFSAFGDPIPWLIALAFFFARGFIKTGLGSRVAYAFVAAFGSSSLGLGYSLVFAEALLAPAIPSVSARAGGIFLPLVKSLCEACGSRAGDGTERKLGAWLMLTCFQTSVVSSAMFLTAMAANPLSANLTAATIGQGIGWTLWAKAAIVPGLLSLVLVPLILYVIYPPEVKASPDAPRLAKERLAKMGPMSTEEKIMAGTLLLTVGLWIFGGMLSVDAVSAAILGLGVLLITGVVTWKECLAESVAWDTLTWFAALIAMAGYLNKYGFISWFSETVVKFVGGLGLSWQASFGVLVLLYFYSHYFFASGAAHIGAMFAAFLSVASALGTPSLFAAMVLSFLSNLMGGTTHYGIGSAPVFYGAGYVPLAQWWGYGFVISIVNIIIWLGAGGFWWKMIGLW

SEQ ID NO: 7444 - protein, 148 aa, Raphanus sativus
EPKPENWKIKMLYDGDCPLCMREVNMLKERNEENGTIKFVDISSNDYSPQENQGLDYKTVMGQIHAIQSDGNVVTGVEAFRKLYEEVGLGWVYTITKFEPIGKVADAVYDFWAKYRLQVTGRPPIEAILEARKKNKVETCGDSKACKT

SEQ ID NO: 7445 - protein, 138 aa, Brassica juncea
MLYDGDCPLCMREVNMLKERNEENGTIKFVDISSNDYSPQENQGLDYKTVMGQIHAIQSDGNVVTGVEAFRRLYEEVGLGWVYTITKFEPIGKVADAVYDFWAKYRLQVTGRPPIEAILEARKKNKVETCGDSKACKT

SEQ ID NO: 7446 - protein, 213 aa, Arabidopsis lyrata
MATRGAAAAASTIWKHRRNPSLRSLSNHFNPNFNHRIIPTGFKYQVRAIQGTSTDPVITPLKNRDEPKPQNWKIKMLYDGDCPLCMREVNMLMERNEKHGTIKFVDISSNDYSPEDNQGLDYKTVMGQIHAIQSDGNVVTGVEAFRRLYEEVGLGWVYTITKFEPIGKLADVVYDVWAKYRLQVTGRPSLEAILEARKKDKVETCGESKDCKI

SEQ ID NO: 7447 - protein, 214 aa, Arabidopsis thaliana
MATRGAVAAAASTIWKHRRNPSLRSLSRHFNPNFNHRIIPTGFKYQVRAIQGTSTDPVITPLKNREEPKPQNWKIKMLYDGDCPLCMREVNMLMERNEKHGTIKFVDISSNDYSPEDNQGLDYKTVMGQIHAIQSDGNVVKGVEAFRRLYEEVGLGWVYTITKFEPIGKLADVVYDVWAKYRLQVTGRPSIEAILEARKKDKVETCGESKNCKI

SEQ ID NO: 7448 - protein, 235 aa, Arabidopsis thaliana
KNQNSIKGAFKILDKNKKKRKMATRGAVAAAASTIWKHRRNPSLRSLSRHFNPNFNHRIIPTGFKYQVRAIQGTSTDPVITPLKNREEPKPQNWKIKMLYDGDCPLCMREVNMLMERNEKHGTIKFVDISSNDYSPEDNQGLDYKTVMGQIHAIQSDGNVVKGVEAFRRLYEEVGLGWVYTITKFEPIGKLADVVYDVWAKYRLQVTGRPSIEAILEARKKDKVETCGESKNCKI

SEQ ID NO: 7449 - protein, 181 aa, Brassica napus
DCTAGDWKNKCYRCGERGHIERNCKNSPKKLRRSGSYSRSPVRSRSPRRRRSPSRSRSLSRSRSYSRSRSPVKRRERSEEERSRSPKRMEDSLSPRGRDRSPIMDDEGSPRIIDGSPPPSPKLEKPAGSDHDGGSSPQDNGNGRNTVASPVVGRDSPREDRSPVDDDYEANRASPRGSESP

SEQ ID NO: 7450 - protein, 118 aa, Raphanus sativus
NKCYRCGERGHIERNCKNSPKKLRRSGSYSRSPVRSRSPPRRRRSPSRSRSLSRSYSRSRSPVKGRERSAEERSRSPKRMEDSLSPRGRDRSPIMDDEGSPRIIDGSPPPSPKLEKQA

SEQ ID NO: 7451 - protein, 62 aa, Arabidopsis lyrata
MISIVIITELLVEYTTALGKLTAGILPRRQGDGNVVRIGSFSIYCPPRSSPIPDFSSHLVDF

SEQ ID NO: 7452 - protein, 44 aa, Brassica napus
MRREIWNRRRSRRTTQRETTDPYNVSVTSPSRKNTSREFREGRR

SEQ ID NO: 7453 - protein, 104 aa, Raphanus sativus
IHYSSQEQKKNQRLSRSFFFSTNHSPDTQQVFQLYSIMISVVIITELLVEYTAALAKLTAGILPRRQGDSNVVRIGGFILPCPSPSSTNRSSPIPDFSSHLVDF

SEQ ID NO: 7454 - protein, 62 aa, Thellungiella halophila
  misc_feature (47)..(47): Xaa can be any naturally occurring amino acid
MISVVIITELLVEYTAALAKLTAGILPRRTGDRNAVRIGGFLLPAPXPSSMIPDFSSHLVDF

SEQ ID NO: 7455 - protein, 203 aa, Glycine max
MNDTRKRLLEIGFKNPILLLHPLGGFVKADDVPLDVRMEQHSKVLEDGVLDPETTIVAIFPSPMHYVGPTEVQWHAKARIDAGANFYIVGRDPTGMGHPTEKRDLYDPDHGKKVLNMAPGLEKLNILPFRVAAYDTKLNKMAFFDPTRAKDFLFIYGTKMRAFAKSGENPPKGFMCPSGWKVLVKYYESLQAEESSQQPVLST

SEQ ID NO: 7456 - protein, 357 aa, Phaseolus coccineus
MREEEYLQSLHFNSLRVKDGSLVNMSLPIVLAIDDETKGRIGSSSHVGLLGPDGDCVAILRSFEIYKHNKEERIARTWGTTAPGLPYVEEVITRAGNWLIGGDLEVLKPIKYNDGLDNYRLSPKQLRDEFDKREADAVFAFQLRNPVHNGHALLMNDTRKRLLEMGYKNPILLLHPLGGFTKADDVPLDVRMEQHSKVLEDGVLDPETTIVAIFPSPMHYAGPTEVQWHAKARINAGANFYIVGRDPAGMGHPTEKRDLYDPDHGKKVLSMAPGLEKLNILPFRVAAYDTKVNKMAFFDPTRAKDFLFISGTKMRAFAKSGENPPEGFMCPSGWNVLVKYYESLQAEEPSEQPVLST

SEQ ID NO: 7457 - protein, 358 aa, Cajanus cajan
MREDEYLQSLHFNSLRVKDGSVVNMSLPIVLAIDDETKGRVESATHVVLVGPDGDYVAILRSIEIYKHNKEERIARTWGTTAPGLPYVEEVITPAGNWLIGGDLEVIKPIKYNDGLDNYRLSPKQLRDEFDKRQADAVFAFQLRNPVHNGHALLMNDTRKRLLDMGYKNPILLLHPLGGFTKADDVPLDVRMEQHSKVLEDGILDPETTIVAIFPSPMHYAGPTEVQWHAKARINAGANFYIVGRDPAGMGHPTEKRDLYDPDHGKKVLSMAPGLEKLNILPFRVAAYDTKVNKMAFFDPTRAKDFLFISGTKMRAYAKSGQNPPEGFMCPSGWKVLVKYYESLQAEEASQQPVLSST

SEQ ID NO: 7458 - protein, 388 aa, Helianthus annuus
EAEGMVKVGLKKIDLEWVHVVSEGWASPLKGFMREDEYLQSLHFNSMRVGDGGVVNMSLPIVLAIDDECKERIGGDSDVALVGPDGTTVAILRSIEIYKHNKEERIARTWGTIAPGLPYVEEAITPAGDWLIGGDLEVLSPIKYNDGLDNYRLSPKQLREEFDRRQADAVFAFQLRNPVHNGHALLMNDTRKRLLDLGYKNPILLLHPLGGYTKADDVPLDVRMEQHSKVLEDGVLDPETTIVSIFPSPMHYAGPTEVQWHAKARINAGANFYIVGRDPAGMGHPTEKRDLYDPDHGKKVLSMAPGLEKLNILPFRVAAYDTVAKQMAFFDPSRAKDFLFISGTKMRTFARTGESPPNGFMCPGGWDVLVKYYASLQTEEAKSVAVST

SEQ ID NO: 7459 - protein, 473 aa, Helianthus annuus
  misc_feature (41)..(41): Xaa can be any naturally occurring amino acid
  misc_feature (46)..(46): Xaa can be any naturally occurring amino acid
  misc_feature (52)..(52): Xaa can be any naturally occurring amino acid
  misc_feature (55)..(55): Xaa can be any naturally occurring amino acid
  misc_feature (76)..(77): Xaa can be any naturally occurring amino acid
  misc_feature (299)..(299): Xaa can be any naturally occurring amino acid
  misc_feature (407)..(407): Xaa can be any naturally occurring amino acid
  misc_feature (440)..(440): Xaa can be any naturally occurring amino acid
MSLTFKPQMITPISHFNKNPSISTTPIYHFNQLTTPHIVFXSRKMXSHAKKXTSXMIIKSSLIEPDGGLLVDLVVXXDQRGVKVAEAEGMVKVGLKKIDLEWVHVVSEGWASPLKGFMREDEYLQSLHFNSLRVGDGGVVNMSLPIVLAIDDECKQRIGGDSDVALVGPDGTTVAILRSIEIYKHNKEERIARTWGTIAPGLPYVEEAITPAGDWLIGGDLEVLSPIKYNDGLDNYRLSPKQLREEFDRRQADAVFAFQLRNPVHNGHALLMNDTRKRLLDLGYKNPILLLHPLGGYTXADDVPLDVRMEQHSKVLEDGVLDPETTIVSIFPSPMHYAGPTEVQWHAKARINAGANFYIVGRDPAGMGHPTEKRDLYDPDHGKKVLSMAPGLEKLNILPFRVAAYDXVAKQMAFFDPSRAKDFLFISGTKMRTFARTGEXPPNGFMCPGGWDVLVKYYASLQTEEAKSVAVSA

SEQ ID NO: 7460 - protein, 455 aa, Helianthus annuus
MSLTVNLNITPLNTHFNPKPKTHKTPTFLTTPIYHSNKLTHKNPTFLTHHTHKKMTSSHVIKSSLIDPDGGVLVDLIVPEDQRGLKCVEAEGMVKVGLTKIDLEWVHVVSEGWASPLKGFMREDEYLQSLHFGSLRIDGCRVNMSLPIVLAIDDETKERIGGDKDVALVGPDGTTVAILRSIEIYKHNKEERIARTWGTTAPGLPYVEEVITPAGNWLIGGDLEVLSPIKYNDGLDSYRLSPKQLREEFDRRQADAVFAFQLRNPVHNGHALLMNDTRKRLLDLGYKNPILLLHPLGGYTKADDVPLDVRMEQHSKVLEDGVLDPETTIVSIFPSPMHYAGPTEVQWHAKARINAGANFYIVGRDPAGMGHPTEKRDLYDPDHGKKVLSMAPGLEKLNILPFRVAAYDTVAKEMAFFDPSRAKDFLFISGTKMRSFARTGESPPNGFMCPGGWDV

SEQ ID NO: 7461 - protein, 471 aa, Artemisia annua
MSLTIKLTHFNLLTKTHNKNQNFKTPIYHTNQLSQSFFVGSTKTTRKMLGGHVVKIKSSLIEPDGGVVIDLVVKENEKDLKLLEAEKMVKIGLKKIDLEWVHVISEGWASPLKGFMRENEYLQSLHFNSLRIGNGSVVNMSLPIVLDIDDETKEKIGSDNDVALVGPDQTVVAILRSIEIYKHNKEERIARTWGTTAPGLPYVEEVITPAGNWLIGGDLEVLAPIKYNDGLDHYRLSPKQLREEFDRRQADAVFAFQLRNPVHNGHALLMNDTRKRLLDMGYKNPILLLHPLGGYTKADDVPLDVRMEQHSKVLEDGVLDPETTIVSIFPSPMHYAGPTEVQWHAKARINAGANFYIVGRDPAGMGHPTEKRDLYDPDHGKKVLSMAPGLEKLNILPFRVAAYDTVAKKMAFFDPSRAKDFLFISGTKMRTYARTGESPPDGFMCPGGWDVLVNYYASLQAEEATPAAVSA

SEQ ID NO: 7462 - protein, 360 aa, Camellia sinensis
MREDEYLQSLHFNCLRMKDGSIVNMSLPIVLAIDDQAKERIGASIHVALVAPDGDLVGVLRSIEIYKHNKEERIARTWGTTAPGLPYVEEVITPAGNWLIGGDLEVLKHIKYNDGLDNYRISPQQLRKEFDKRQADAVFAFQLRNPVHNGHALLMNDTRRRLLEMGYKNPILLLHPLGGFTKADDVPLDVRMEQHSKVLEDGILDPETTVVAIFPSPMHYAGPTEVQWHAKARINAGANFYIVGRDPAGMDHPIEKRDLYDPDHGKKVLSMAPGLEKLNILPFKVAAYDTVEKRMAFFEPSRAKDFLFISGTKMRTYARNGENPPDGFMCPGGWEVLVKYYASLQTEETPQKPAVLSTQT

SEQ ID NO: 7463 - protein, 481 aa, Populus trichocarpa
MSLTIKLTITPHIINLNLHPKHRTKIPAYSLGVRPKPIYHSNALIPILYNNKQPRMSQASVSGSVIKSSLIEPDGGVVVDVIVPECERGSKTLEAESLPKVRLARIDVEWVHVISEGWASPLKGFMRENEYLQSLHFNSLRMGNGTVVNMSLPIVLAIDDETKENIGSAKDVGLVGPDGDLLAILRSTEIYKHNKEERIARTWGTTAPGLPYVEEFITPAGNWLIGGDLEVLKPIKYNDGLDHYRLSPQQLRKEFDRRQADAVFAFQLRNPVHNGHALLMNDTRRRLLEMGYKNPILLLHPLGGFTKADDVPLAVRMEQHSKVLEDGVLDPETTIVAIFPSPMHYAGPTEVQWHAKARINAGANFYIVGRDPAGMGHPTEKRDLYDPDHGKKVLSMAPGLEKLNILPFRVAAYDTVAKKMAFFDPSRSKDFLFISGTKMRTYARTGENPPDGFMCPGGWEVLVKYYERLQAEEATPAAVSA

SEQ ID NO: 7464 - protein, 472 aa, Manihot esculenta
NTLNLHTNHKTKFTSYSTRIRPKHIYHCNPLIHFVYNKAKMRDSSNPVESSIPLVKSSLIEPDGGALVDLVVPESERGAKTLEAGSMPKVRLTKIDVEWVHVISEGWTSPLRGFMRENEYLQSLHFNSLRMADGSVVNMSLPIVLAIDDETKDRIGSSKNVVLVAPDGDLIGILRSIEIYKHNKEERIARTWGTTAPGLPYVEKCITPAGNWLIGGDLEVIKPIKYNDGLDHYRLSPQQLRKEFDRRQADAVFAFQLRNPVHNGHALLMNDTRRRLLDMGYKNPILLLHPLGGFTKADDVPLDVRMEQHSKVLEDGILDPKTTIVSIFPSPMHYAGPTEVQWHAKARINAGANFYIVGRDPAGMGHPTENRDLYDPDHGKKVLSMAPGLEKLNILPFRVAAYDTVAKKMAFFDPSRSQDFLFISGTKMRTYARNGENPPDGFMCPGGWKVLVQYYESFQVEEAPQKPAVLST

SEQ ID NO: 7465 - protein, 484 aa, Manihot esculenta
MSLTIRLHIAPYKTLNLSDINKTKISSFSTRIRPKPIYHSNSLIHFVYDKPKMLDSSNPVESSIPSIKSSLIEPDGGALVDLVVPESERGARALEAESMPKVRLTKIDVEWVHVISEGWASPLTGFMRENEYLQSLHFNSLRMADGTVVNMSLPIVLAIDDETKERIGSSKNVGLVASDGDLIGILRSIEIYKHNKEERIARTWGTTAPGLPYVEECITSAGNWLIGGDLEVLKPIKYNDGLDHYRLSAQQLRKEFDNRQADAVFAFQLRNPVHNGHALLMNDTRRRLLEMGYKNPILLLHPLGGFTKADDVPLDVRMEQHSKVLEDGVLDPKTTIVSIFPSPMHYAGPTEVQWHAKARINAGANFYIVGRDPAGMGHPTEKRDLYDPDHGKKVLSMAPGLEKLNILPFRVAAYDTVAKKMAFFDPSRSQDFLFISGTKMRTYARTGENPPDGFMCPGGWKVLVKYYESLQVEEAPKKPTVLST

SEQ ID NO: 7466 - protein, 488 aa, Cleome gynandra
MSVLMRSYCVSHTANLNLVQPKNSKASGYIDRNRVRFGSISSFSRNPFLRFVYNRKPKMESVSSSSPVIVKSSLIDPDGGALVDLVVPESELGLKKAETEAMPRVSLTKIDLEWVHVISEGWASPLRGFMREDQYLQSLHFNSLRMSDGSVVNMSLPIVLAIDDETKERVGASENVALVGPEGDIIGSLRSIEIYKHNKEERIARTWGTTAPGLPYVEEYITPAGNWLIGGDLEVLHPIKYNDGLDHYRLSPKQLRKEFDRRQADAVFAFQLRNPVHNGHALLMNDTRRRLLEMGYKNPILLLHPLGGFTKADDVPLDVRMEQHSKVLEDGVLDPETTIVSIFPSPMHYAGPTEVQWHAKARINAGANFYIVGRDPAGMGHPTEKRDLYDPDHGKKVLSMAPGLEKLNILPFRLAAYDTTTKKMAFFDPSRAKDFLFISGTKMRTFAKTGENPPDGFMCPSGWTVLVKYYESLQESEATTQQPATVSS

SEQ ID NO: 7467 - protein, 432 aa, Tropaeolum majus
MVDSSKAVQSLSGVIKSSLIEPDGGVVVDLIVPEKERGSKTLEAESMPKVKLTKIDLEWVHVISEGWASPLRGFMREDEYLQSLHFNFLRTKDGAIVNMSLPIVLAIDDETKDRIGSSTQVALVGPGGDLIALLRSIEIYKHNKEERIARTWGTTAPGLPYVEEAITQAGNWLIGGDLEVLSPIKYNDGLDHYRLSPKQLRHEFDSRQADAVFAFQLRNPVHNGHALLMNDTRRRLLEMGYKNPILLLHPLGGFTKADDVPLDVRMEQHSKVLEDGVLDPKTTIVAIFPSPMHYAGPTEVQWHAKSRINAGANFYIVGRDPAGMGHPTEKRDLYDPDHGKKVLSMAPGLEKLNILPFRVAAYDTVEKKMAFFDPSRAKDFLFISGTKMRTFARTGENPPDGFMCRGGWEVLVKYYESLQAEETTKQQAVMSS

SEQ ID NO: 7468 - protein, 483 aa, Prunus persica
MSLTIKLHVTTSYLNLNLNTSKNTTKVANFKVKLRTKPIYHCDPLLSVVSNTSAMHASALPGQPAIRSSLIDPDGGALVDLVVPESKKASKALEAESLPKVNLTKVDLEWVHVISEGWASPLRGFMREDQYLQSLHFNSLRTQDGSLVNMSLPIVLAIDDETKERIGSSPNVGLLGPNGDLIGILSSIEIYKHNKEERIARTWGSTAPGLPYVEEAITPAGNWLIGGDLEVLEHIKYNDGLDHYRLSPQQLRKEFDRRQADAVFAFQLRNPVHNGHALLMNDTRRRLLEMGYKNPILLLHPLGGFTKPDDVPLDVRMEQHSKVLEDGVLDPETTIVGIFPSPMHYAGPTEVQWHAKARINAGANFYIVGRDPAGMGHPTEKRDLYDPDHGKKVLSMAPGLEKLNILPFRVAAYDNVEKKMAFFDPSRAKDFLFISGTKMRAFAKSGENPPDGFMCPGGWKVLVNYYESLQTEEASQQQAVLST

SEQ ID NO: 7469 - protein, 481 aa, Populus trichocarpa
MSLTIKLTITPHIINLNLHPKHRTKIPAYSLGVRPKPIYHSNALIPILYNNKQPRMSQASVSGSVIKSSLIEPDGGVVVDVIVPECERGSKTLEAESLPKVRLARIDVEWVHVISEGWASPLKGFMRENEYLQSLHFNSLRMGNETVVNMSLPIVLAIDDETKENIGSAKDVGLVGPDGDLLAILRSTEIYKHNKEERIARTWGTTAPGLPYVEEFITPAGNWLIGGDLEVLKPIKYNDGLDHYRLSPQQLRKEFDRRQADAVFAFQLRNPVHNGHALLMNDTRRRLLEMGYKNPILLLHPLGGFTKADDVPLAVRMEQHSKVLEDGVLDPETTIVAIFPSPMHYAGPTEVQWHAKARINAGANFYIVGRDPAGMGHPTEKRDLYDPDHGKKVLSMAPGLEKLNILPFRVAAYDTVAKKMAFFDPSRSKDFLFISGTKMRTYARTGENPPDGFMCPGGWEVLVKYYERLQAEEATPAAVSA

SEQ ID NO: 7470 - protein, 477 aa, Populus trichocarpa
MSLTIKLTISPRIINLNCHERNRTKFPAIRPKPIYHSNALNPILYNNKRPGMIQASVSGTVIKSSLIEPDGGVLVDVIVPESERGSKTLEAESLPKARLAKIDVEWVHVISEGWASPLKGFMRENEYLQSLHFNSLRMENRTVVNMSLPIVLAIDDETKESIGSSKDVGLVGPEGDLLAILRSIEIYKHNKEERIARTWGTTAPGLPYVEEFIAPAGNWLLGGDLEVLKPIKYNDGLDHYRLSPKQLRKEFDRRQADAVFAFQLRNPVHNGHALLMNDTRRRLLEMGYKNPILLLHPLGGFTKADDVPLDVRMEQHSKVLEDGVLDPETTIVAVFPSPMHYAGPTEVQWHAKARVNAGANFYIVGRDPAGMGHPTEKRDLYDPDHGKKVLSMAQGLEKLNILPFRVAAYDTVAKKMAFFDPSRSKEFLFISGTKMRAYARNGENPPDGFMCPGGWEVLVKYYEQLQAEEAMPVVASA

SEQ ID NO: 7471 - protein, 442 aa, Helianthus annuus
  misc_feature (160)..(160): Xaa can be any naturally occurring amino acid
  misc_feature (186)..(186): Xaa can be any naturally occurring amino acid
  misc_feature (263)..(263): Xaa can be any naturally occurring amino acid
  misc_feature (317)..(317): Xaa can be any naturally occurring amino acid
  misc_feature (374)..(374): Xaa can be any naturally occurring amino acid
MSLTINLNIAPLTTHFNPKPKTHKAPTFLTTPIYHSNILTHKNPTFLAHHTHKKMTSSHVIRSSLIDPDGGVLVDLIVPEDQRGLKCIEAEGMVKVGLTKIDLEWVHVVSEGWASPLKGFMREDEYLQSLHFGSLRIDGCRVNMSLPIVLAIDDETKERXGGDKDVALVGPDSNTVAILRSIEIYXHNKEERIARTWGTTAPGLPYVEEVITPAGNWLIGGDLEVLSPIKYNDGLDSYRLSPKQLREEFDRRQADAVFAFQLXNPVHNGHALLMNDTRKRLLDLGYKNPILLLHPLGGYTKADDVPLDVRMEQHSKXLEDGVLDPETTIVSIFPSPMHYAGPTEVQWHAKARINAGANFYIVGRDPAGMGHPTXKRDLYDPDHGKKVLSMAPGLEKLNILPFRVAAYDTVAKEMAFFDPSRAKDFLFISGTKMRSFARTGES

SEQ ID NO: 7472 - protein, 422 aa, Tragopogon dubius
MSLTIKLRITPSASHFDLNRKTHKNPIVLRTPIYHSNKLSTSLVFRTKKMAASHVIKSSLIEPDGGVLIDLVVPENQRDLKASEAEGMTKVKLTKIDLEWVHVISEGWASPLKGFMREDEYLQSLHFNSLRMKNDNGNGSIVNMSLPIVLAIDDETKEKIGSANDVALLGPDQKIVAILRSIEIYKHNKEERIARTWGTTASGLPYVEEVITPSGNWLIGGDLEVLKPIKYNDGLDNYRLSPKQLRKEFDRREADAVFAFQLRNPVHNGHALLMNDTRGRLLDMGYKNPILLLHPLGGYTKADDVPLDVRMEQHSKVLEDGVLDPETTIVSIFPSPMHYAGPTEVQWHAKARINAGANFYIVGRDPAGMGHPTEKRDLYDPDHGKKVLSMAPGLEKLNILPFRVAAYDMVAKKMVFFVPFTC

SEQ ID NO: 7473 - protein, 489 aa, Cleome spinosa
MSLLIRSYRVSHTPDRNILLPRNSKPSCHIVRNRVRFGSISGFNRNPFLRLVYTRKPRMESVSSSSPVIVKSSLIDPDGGALVDLVVPESELGLKKSEAEAMPRVRLTKIDLEWVHVISEGWASPLRGFMREDQYLQSLHFNSLRMSDGSVVNMSLPIVLAIDDETKERVGSSENVALVGPDGDIIGSLRSIEIYKHNKEERIARTWGTTAPGLPYVEEYITRSGNWLIGGDLEVFQPVKYNDGLDHYRLSPKQLRKEFDRRQADAVFAFQLRNPVHNGHALLMNDTRKRLLEMGYKNPILLLHPLGGFTKADDVPLDVRMEQHSKVLEDGVLDPETTIVSIFPSPMHYAGPTEVQWHAKARINAGANFYIVGRDPAGMGHPTEKRDLYDPDHGKKVLSMAPGLEKLNILPFRVAAYDITEKKMAFFDPSRAKDFLFISGTKMRTYARTGENPPDGFMCPSGWKVLVKYYESLQENEASTQKPAAVVSS

SEQ ID NO: 7474 - protein, 309 aa, Antirrhinum majus
  misc_feature (128)..(128): Xaa can be any naturally occurring amino acid
  misc_feature (283)..(283): Xaa can be any naturally occurring amino acid
  misc_feature (290)..(290): Xaa can be any naturally occurring amino acid
QKIQPLSSDSPKNPLMVKSSLIEPDGGSLVDLVVPETQRAAKISEAEAMPKVKLTKIDLEWVHVISEGWASPLKGFMREDEYLQSLHFNCLRMKDGSLINMSLPIVLAIDDDDKDKIGGSASVALVGXGGDLVGILNSIEIYKHNKEERIARTWGTTAPGLPYVEEVITPAGNWLIGGDLEVLKPIKYNDGLDHYRLSPQQLRNEFDKRQADAVFAFQLRNPVHNGHALLMNDTRRRLLEMGFKNPILLLHPLGGFTKADDVPLDVRMEQHSKVLEEGFLTLXLPLYLFXLHRCIMLDQQKYSGMQRHG

SEQ ID NO: 7475 - protein, 486 aa, Malus domestica
MSLTIKLHDCHLNLLNNNHLGISKPKTKVPNLKLKFRTKPIYHSDPLLSVVYNSTMHASSARPPQSAVIKSSLIDPDGGALVDLVVPESQRAAKALEAEALPKVRLTKIDLEWVHVISEGWASPLRGFMREDQYLQSLHFNSLRIEDGSFVNMSLPIVLAIDDETKERIGSSNNVGLVGPGGDLVGVLSSIEIYKHNKEERIARTWGSTAPGLPYVEEVITPAGNWLIGGDLEVLDRVKYNDGLDHYRLSPRQLRKEFDRRQADAVFAFQLRNPVHNGHTLLMNDTRRRLLDMGYKNPILLLHPLGGFTKPDDVPLDVRMEQHSKVLEDGVLDPETTIVGIFPSPMHYAGPTEVQWHAKARINAGANFYIVGRDPAGMGHPTEKRDLYDPDHGKKVLSMAPGLEKLNILPFRVAAYDTVEKKMAFFDPSRAKDFLFISGTKMRAYAKSGENPPDGFMCPSGWKVLVNYYKSLQTEEASQQQAVLST

SEQ ID NO: 7476 - protein, 478 aa, Ricinus communis
MSLTIKLHITPYNTLNLLTNTKTKFTSYTTRIRPKAIYHTNPLLHCVYNNQPRMQSSSFPCIKSSLIDPDGGSLVDLVVPESQRELKANEAASMPKVKLTKIDVEWVHVICEGWASPLKGFMRENEYLQSLHFNCLRMEDGSLVNMSLPIVLAIDDETKERIGSEKNVGLVAPDGELIATLRSIEIYKHNKEERIARTWGTTAPGLPYVEEYITPAGNWLVGGNLEVLKPIKYNDGLDDYRLSPKQLRKEFDMREADAVFAFQLRNPVHNGHALLMNDTRRRLLEMGYKNPILLLHPLGGFTKADDVPLDVRMEQHSKVLEDGVLDPKTTIVAIFPSPMHYAGPTEVQWHAKARINAGANFYIVGRDPAGMGHPTEKRDLYDPDHGKKVLSMAPGLEKLNILPFRVAAYDTLAKKMAFFDPSRAQDFLFISGTKMRTYARTGENPPDGFMCPSGWEVLVRYYQSLQVEEAQKATVLSA

SEQ ID NO: 7477 - protein, 484 aa, Quercus alba
MSLTVKLHITNQLNLNLGQTSIINKTKFYTPRIRTKPIYHSNPLISTTSYNNKPITTMHVPSYSSSIKSSLIDPDGGALVDLVVPERERAKKKLEAEALPPVRLTKIDVEWVHVISEGWASPLRGFMRESEYLQSLHFNCLRTESGSLVNMSLPMVLAIDDDTKTRIGSSPNVGLVGPNGDLVGILRSIEIYKHNKEERIARTWGTTTPGLPYVEEVITPAGNWLVGGDLEVLNPIKYNDGLDHYRLSPQQLRKEFDRRQADAVFAFQLRNPVHNGHALLMNDTRKRLLEMGYKNPILLLHPLGGFTKADDVPLDVRMEQHSKVLEDGILDPETTIVAIFPSPMHYAGPTEVQWHAKARINAGANFYIVGRDPAGMGHPTEKRDLYDPDHGKKVLSMAPGLEKLNILPFRVAAYDTVEKKMAFFEPSRAKDFLFISGTKMRTYARTGENPPDGFMCPAGWSVLVKYYESLQAEEALQQQAVLTS

SEQ ID NO: 7478 - protein, 297 aa, Lactuca sativa
MSLTIKLRIAPTISHFDLNRKTQKNPIISRTPIYHSNKLSTSLLFRTKKMAASHVIKSSLIEPDGGVLIDLVVPENQRELKASQAEGMEKVQLTKIDLEWVHVISEGWASPLKGFMREDEYLQSLHFNSLRMKNDDGYGSIVNMSLPIVLAIDDATKEKIGGANDVALVGPDQKIVAILRSIEIYKHNKEERIARTWGTIAPGLPYVEEVITPSGNWLIGGDLEVLSPIKYNDGLDNYRLSPKQLRKEFDRRQADAVFAFQLRNPVHNGHALLMNDTRRRLLDMGYKNPYLLLHPLG

SEQ ID NO: 7479 - protein, 483 aa, Cucumis sativus
MSLFTKLHIAISPQFTINNLQTTKKTTSIPIYNSKIQSKHIYVSHPLVLFKSTMQSHSPRSLRSSIKCSLIDPDGGVVVDLVVPESERASRVLEAEPLPKVKLTQIDLEWVHVISEGWASPLRGFMREDEYLQSLHFNCIKIKDGSFVNMSLPIVLAIGDDVKDQIGSSSNVGLLGPNGDLVGILRSIEIFKHNKEERIARTWGTTAPGLPYVDEVITNAGNWLLGGDLEVINPIKYNDGLDHYRLSPKQLRQEFDRRQADAVFAFQLRNPVHNGHALLMNDTRKRLLDMGYKNPILLLHPLGGFTKADDVPLDVRMEQHSKVLEDGILDPETTIVSIFPSPMHYAGPTEVQWHAKARINAGANFYIVGRDPAGMGHPTEKRDLYDPDHGKKVLSMAPGLEKLNILPFKVAAYDTVAKKMAFFDPTRAKDFLFISGTKMRTYARTGENPPDGFMCPGGWKVLVNYYESLQAEEASPQQAALSV

SEQ ID NO: 7480 - protein, 261 aa, Euphorbia esula
NEYLQSLHFNSMRMEDGSIVNMSLPIVLAIDDETKERIGDSKDVALVAPDGDLVGTLKSIEIYKHNKEERIARTWGTTSPGLPYVEEYITPAGNWLIGGDLEVLKPIKYDDGLDNYRLSPKQLRLEFDNRQADAVFAFQLRNPVHNGHALLMNDTRRRLLDMGYKNPILLLHPLGGFTKADDVPLDVRMEQHSKVLEDGVLDPATTIVAIFPSPMHYAGPTEVQWHAKARINAGANFYIVGRDPAGMGHPTEKRDLYDPDH

SEQ ID NO: 7481 - protein, 261 aa, Lactuca sativa
MSLTIKLRIAPTISHFDLNRKTQKNPIISRTPIYHSNKLSTSLLFRTKKMAASHVIKSSLIEPDGGVLIDLVVPENQRELKASQAEGMEKVQLTKIDLEWVHVISEGWASPLKGFMREDEYLQSLHFNSLRMKNDDGYGSIVNMSLPIVLAIDDATKEKIGGANDVALVGPDQKIVAILRSIEIYKHNKEERIARTWGTIAPGLPYVEEVITPSGNWLIGGDLEVLSPIKYNDGLDNYRLSPKQLRKEFDRRQADAVFAFH

SEQ ID NO: 7482 - protein, 477 aa, Arabidopsis lyrata
MSLLIRSSSYVSHLTLFQPRNSKPSSFTNQISFVSSFNQNPFLNLVYKRNPIMQSVSKMTVKSSLIDPDGGELVELIVPESEIGAKRAESETMPKVKLTKIDLEWVHVISEGWASPLKGFMREDEYLQSLHFNSLRLKNGTFVNMSLPIVLAIDEETKEQIGSSKNVALVSPQGDIIGSLRSVEIYKHNKEERIARTWGTTSPGLPYVEEYISPSGNWLIGGDLEVFKPIKYNDGLDHYRLSPKQLREEFDNRQADAVFAFQLRNPVHNGHALLMNDTRKRLLDMGYKNPILLLHPLGGFTKADDVPLDVRMEQHSKVLEDGVLDPKTTIVSIFPSPMHYAGPTEVQWHAKARINAGANFYIVGRDPAGMGHPTEKRDLYDPDHGKKVLNMAPGLEKLNILPFRVAAYDTIEKKMAFFDPSRAKEFLFISGTKMRTYARTGENPPDGFMCPSGWNVLVKYYESLQESEAKQQAVVSA

SEQ ID NO: 7483 - protein, 476 aa, Aquilegia formosa
KSHLNNTHYLVNFQQNSTRRNQNTRIQTKHIFHFNSLQHFINLSMKKSLSSSSSSSSLIKSSLIDPDGGPLVDLVVPENEKALKKKEAESMPKLKLSKIDLEWVHVISEGWANPLKGFMREDEYLQSMHFNFLRLNDGNIVNMSLPIVLAIDDKDKETIGLSSDVGLIAPDGNLIAILRSVQIYKHNKEERIARIWGTTAPGLPYVEEVITPAGNWLIGGDLEVLEPIKYNDGLDHYRLSPRELRKEFDKRQADAVFAFQLRNPVHNGHALLMNDTRRRLLEMGYKNPILLLHPLGGFVKADDVPLDVRMEQHSKVLEDGVLDPETTIVAIFPSPMHYAGPTEVQWHAKARINAGANFYIVGRDPAGMSHPTEKRDLYDPDHGKKVLSMAPGLEKLNILPFKVAAYDKTAKKMAFFDPSRAQDFLFISGTKMRAYAKSGEDPPDGFMCPGGWKVLVEYYKSLQAEEADQQSTVMSA

SEQ ID NO: 7484 - protein, 476 aa, Aquilegia formosa
KSHLNNTHYLVNFQQNSTRRNQNTRIQTKHIFHFNSLQHFINLSMKKSLSSSSSSSSLIKSSLIDPDGGPLVDLVVPENEKALKKKEAESMPKLKLSKIDLEWVHVISEGWANPLKGFMREDEYLQSMHFNFLRLNDGNIVNMSLPIVLAIDDKDKETIGLSSDVGLIAPDGNLIAILRSVQIYKHNKEERIARIWGTTAPGLPYVEEVITPAGNWLIGGDLEVLEPIKYNDGLDHYRLSPRELRKEFDKRQADAVFAFQLRNPVHNGHALLMNDTRRRLLEMGYKNPILLLHPLGGFVKADDVPLDVRMEQHSKVLEDGVLDPETTIVAIFPSPMHYAGPTEVQWHAKARINAGANFYIVGRDPAGMSHPTEKRDLYDPDHGKKVLSMAPGLEKLNILPFKVAAYDKTAKKMAFFDPSRAQDFLFISGTKMRAYAKSGEDPPDGFMCPGGWKVLVEYYKSLQAKEADQQSTVMSA

SEQ ID NO: 7485 - protein, 476 aa, Arabidopsis thaliana
MSLMIRSSYVSHITLFQPRNSKPSSFTNQISFLSSSNNNPFLNLVYKRNLTMQSVSKMTVKSSLIDPDGGELVELIVPETEIGVKKAESETMPKVKLNQIDLEWVHVISEGWASPLKGFMREDEYLQSLHFNSLRLKNGTFVNMSLPIVLAIDDDTKEQIGSSENVALVCPQGDIIGSLRSVEIYKHNKEERIARTWGTTSPGLPYVEEYITPSGNWLIGGDLEVFEPIKYNDGLDHYRLSPKQLREEFDNRQADAVFAFQLRNPVHNGHALLMNDTRKRLLEMGYKNPVLLLHPLGGFTKADDVPLDVRMEQHSKVLEDGVLDPKTTIVSIFPSPMHYAGPTEVQWHAKARINAGANFYIVGRDPAGMGHPTEKRDLYDPDHGKRVLSMAPGLEKLNILPFRVAAYDTIEKKMAFFDPSRAKEFLFISGTKMRTYARTGENPPDGFMCPSGWNVLVKYYESLQESEAKQQAVVSA

SEQ ID NO: 7486 - protein, 483 aa, Brassica napus
MSLLIRSSYVSQFHTRNSNPSSFSDQTPSKSPFFSSFNHNPLIKLVYKRNPRMQSLSFPSSMTVKSSLIDPDGGELMELVVPDSEIELKKKEAESMPKVKLTKIDMEWVHVISEGWASPLKGFMREDEYLQSLHFNSLRLKDGSLVNMSLPIVLAIDDQTKEQIGVSKNVALVSPQGDIVGSLRSVEIYKHNKEERIARTWGTTSPGLPYVEEHITPSGNWLIGGDLEVFQPVKYNDGLDHYRLSPKQLRKEFDNRKADAVFAFQLRNPVHNGHALLMNDTRKRLLEMGYKNPVLLLHPLGGFTKADDVPLDVRMEQHSKVLEDGVLDPETTIVSIFPSPMHYAGPTEVQWHAKARINAGANFYIVGRDPAGMGHPTEKRDLYDPDHGKKVLSMAPGLEKLNILPFRVAAYDTVEKKMAFFDPTRAKEFLFISGTKMRTYARTGESPPDGFMCPSGWNVLVKYYESLQESDDSSKQQQTVVSA

SEQ ID NO: 7487 - protein, 233 aa, Brassica napus
TMQPPTFTPSMTVKSSLIDPDGGELVELMVPESEIKLKKKESEAMPKVELTKIDLEWVHVISEGWASPLKGFMREDEYLQSLHFNSLRLKDGSLVNMSLPILLAIDDDTKEQIGVSKNVALVSPQGDIIGSLRSVEIYKHNKEERIARTWGTTSPGLPYVEEHITPSGNWLIGGDLEVFQPIKYNDGLDHYRLSPKQLRKEFDNRQADAVFAFQLRNPVHNGHALLMNDTRKR

SEQ ID NO: 7488 - protein, 484 aa, Mimulus guttatus
MSLTIKLQHVVSNTHVNPTTTTATAIKKTRSATKLHSKPIYHTNPLSPLALTRTRKMQSLPRNPKMVVKSSLIDPDGGSLVDLAVPEGKRAERIAAAEKMPKVKLTKIDLEWVHVIGEGWASPLKGFMREDEYLQSLHFNCLRMKDGSFVNMSLPIVLAVDDGVKEEIGGSDSVALVGPGGDLVAILTSIEIFKHNKEERIARTWGTTAPGLPYVDEAIAQTGNWLVGGDLEVINPIKYNDGLDNYRLSPKQLREEFDKREADAVFAFQLRNPVHNGHALLMNDTRKRLLDMGFKNPILLLHPLGGFTKADDVPLDVRMEQHSKVLEDGILDPETTIVAIFPSPMLYAGPTEVQWHAKARLNAGANFYIVGRDPAGMAHPTEKRDLYDPDHGKKVLSMAPGLEKLNILPFRVAAYDTVAKKMAFFEPSRAKDFLFISGTKMRTYARTGENPPDGFMCPGGWQVLVKYYESLQAEDSPTKQTVNA

SEQ ID NO: 7489 - protein, 483 aa, Brassica oleracea
  misc_feature (207)..(207): Xaa can be any naturally occurring amino acid
  misc_feature (231)..(231): Xaa can be any naturally occurring amino acid
  misc_feature (277)..(277): Xaa can be any naturally occurring amino acid
  misc_feature (294)..(294): Xaa can be any naturally occurring amino acid
  misc_feature (312)..(312): Xaa can be any naturally occurring amino acid
  misc_feature (314)..(314): Xaa can be any naturally occurring amino acid
  misc_feature (441)..(441): Xaa can be any naturally occurring amino acid
  misc_feature (479)..(479): Xaa can be any naturally occurring amino acid
MSLLIRSSYVSQFHTRNSKPSSFSDQTPSKSPFFSSFNHNPLINLVYKRNPRMQSLSFPSSMTVKSSLIDPDGGELVELVVPDSEIELKKKEAESMPKVKLTKIDLEWVHVISEGWASPLKGFMREDEYLQSLHFNSLRLKDGSLVNMSLPIVLAIDDQTKEQIGVSKNVALVSPQGDIVGSLRSVEIYKHNKEERIARTWGTTSPXLPYVEEHITPSGNWLIGGDLEVFXPVKYNDGLDHYRLSPKQLRKEFDNRKADAVFAFQLRNPVHNGHALXMNDTRKRLLEMGYKNPXLLLHPLGGFTKADDVPLXVXMEQHSKVLEDGVLDPETTIVSIFPSPMHYAGPTEVQWHAKARINAGANFYIVGRDPAGMGHPTEKRDLYDPDHGKKVLSMAPGLEKLNILPFRVAAYDTVEKKMAFFDPTRAKEFLFISGTKMRTYXRTGESPPDGFMCPSGWNVLVKYYESLQESDDSSKQQQXVVSA

SEQ ID NO: 7490 - protein, 483 aa, Brassica rapa
LSLLIRSSYVSQFHTRNSKPSSSSDQIPSKSLLFSSFNHNPLINLVYKRNPRMQSLSFPSLTTVKSSLIDPDGGELVELVVPKSEIELKKKEADSMPMVKLTKIDMEWVHVISEGWASPLKGFMREDEYLQSLHFNSLRLKDGSFVNMSLPIVLAIDDQTKEQIGVSKNVALVSPQGDIIGSLRSVEIYKHNKEERIARTWGTTSPGLPYVEEHITPSGNWLIGGDLEVFQAIKYNDGLDHYRLSPKQLRKEFDNRKADAVFAFQLRNPVHNGHALLMNDTRKRLLEMGYKNPVLLLHPLGGFTKADDVPLDVRMEQHSKVLEDGVLDPETTIVSIFPSPMHYAGPTEVQWHAKARINAGANFYIVGRDPAGMGHPTEKRDLYDPDHGKKVLSMAPGLEKLNILPFRVAAYDTVEKKMAFFDPTRAKEFLFISGTKMRTYARTGESPPDGFMCPSGWNVLVKYYESLQESDDSSKQQQTVVSA

SEQ ID NO: 7491 - protein, 484 aa, Mimulus guttatus
MSLTIKLQHVVNNTHVNPTTTTATAIKKTRSATKLHSKPIYHTNPLSPLALTRTRKMQSLPRNPPMVVKSSLIDPDGGSLVDLAVPEGKRAERIAAAEKMPKVKLTRIDLEWVHVIGEGWASPLKGFMREDEYLQSLHFNCLRMKDGSFVNMSLPIVLGVDDGVKEEIGGSDSVALVGPGGDLVAILTSIEIFKHNKEERIARTWGTTAPGLPYVDEAIAQAGNWLVGGDLEVINPIKYNDGLDNYRLSPKQLRAEFDKREADAVFAFQLRNPVHNGHALLMNDTRKRLLDMGFKNPILLLHPLGGFTKADDVPLDVRMEQHSKVLEDGILDPETTIVAIFPSPMLYAGPTEVQWHAKARLNAGANFYIVGRDPAGMAHPTEKRDLYDPDHGKKVLSMAPGLEKLNILPFRVAAYDTVAKKMAFFEPSRAKDFLFISGTKMRTYARTGENPPDGFMCPGGWQVLVKYYESLQAEDSPTKQTVNA

SEQ ID NO: 7492 - protein, 320 aa, Centaurea maculosa
  misc_feature (19)..(19): Xaa can be any naturally occurring amino acid
  misc_feature (24)..(24): Xaa can be any naturally occurring amino acid
  misc_feature (46)..(46): Xaa can be any naturally occurring amino acid
  misc_feature (284)..(315): Xaa can be any naturally occurring amino acid
  misc_feature (317)..(318): Xaa can be any naturally occurring amino acid
MVNMSLPIVLAIDDETKEXIGGDXDVALVGPDNKTIAILRSIEIYXHNKEERIARTWGTIAPGLPYVEEVITPAGNWLIGGDLEVLSPIKYNDGLDNYRLSPKQLREEFDRREADAVFAFQLRNPVHNGHALLMNDTRRRLLEMGYKNPILLLHPLGGYTKADDVPLDVRMEQHSKVLEDGVLDPKTTIVSIFPSPMHYAGPTEVQWHAKARINAGANFYIVGRDPAGMGHPTEKRDLYDPDHGKKVLSMAPGLEKLNILPFRVAAYDTVAKKMAFFDPSRAKXXXXXXXXXXXXXXXXXXXXXXXXXXXXXXXXLXXYY

SEQ ID NO: 7493 - protein, 329 aa, Taraxacum officinale
MSLTIKLLVTPTISHLDLNRKTQQIPINLRTPIYHSNKLSTSLVFRTKKMAASHVIKSSLIEPDGGILIDLVVPENQRDMKASEAEGMTKVQLTKIDLEWVHVISEGWASPLKGFMREDEYLQSLHFNSLRMKNDDGYGTIVNMSLPIVLAIDDATKEKIGGANDVALVGHDQKIVAILRSIEIYKHNKEERIARTWGTTAPGLPYVEESITPSGNFLIGGDLEVLSPIKYNDGLDHYRLSPKQLRKEFDRRQADAVFAFQLRNPVHNGHALLMNDTRRRLLDMGYKNPILLLHPLGGFTKADDVPLDVRMEQHSKVLSTFPIKSFFQY

SEQ ID NO: 7494 - protein, 483 aa, Brassica napus
MSLLIRSSYVSQFHTRNSKPSSSSDQIPSKSLLFSSFNHNPLIKLVYKRNPRMQSLSFPSLTTVKSSLIDPDGGELVELVVPDSEIEPKKKEADSMPMVKLTKIDMEWVHVISEGWASPLKGFMREDEYLQSLHFNSLRLKDGSLVNMSLPIVLAIDDQIKEQIGVSKNIALVSPQGDIIGSLRSVEIYKHNKEERIARTWGTTSPGLPYVEEHITPSGNWLIGGDLEVFQPIKYNDGLDHYRLSPKQLRKEFDNRKADAVFAFQLRNPVHNGHALLMNDTRKRLLEMGYKNPILLLHPLGGFTKADDVPLDVRMEQHSKVLEDGVLDPETTIVSIFPSPMHYAGPTEVQWHAKARINAGANFYIVGRDPAGMGHPTEKRDLYDPDHGKKVLSMAPGLEKLNILPFRVAAYDTVEKKMAFFDPTRAKEFLFISGTKMRTYARTGESPPDGFMCPSGWNVLVKYYESLQESDDSSKQQQTVVSA

SEQ ID NO: 7495 - protein, 234 aa, Coffea canephora
LSFQEKMSSLPFSSPKGNGTIKSSLIDPDGGSLVDLVVPESQRAAKISEAESMPKVKLTKIDLEWVHVISEGWASPLRGFMRENEYLQSLHFNCLRLKDGSVVNMSLPIVLAIDDETKEKIGGSTDVALTGPNDALVGILRRIEIYKHHKEERIARTWGTIAPGLPYVEEVITSAGNWLVGGDLEVLEPIIYNDGLDRYRLSPQQLRKEFDHRQADAVFAFQLRNPVHNGHALL

SEQ ID NO: 7496 - protein, 483 aa, Brassica napus
  misc_feature (232)..(233): Xaa can be any naturally occurring amino acid
MSLLIRSSYVSQFHTRNSKPSSSSDQIPSKSLLFSSFNHNPLIKLVYKRNPRMQSLSFPSLTTVKSSLIDPDGGELVELVVPDSEIEPKKKEADSMPMVKLTKIDMEWVHVISEGWASPLKGFMREDEYLQSLHFNSLRLKDGSLVNMSLPIVLAIDDQIKEQIGVSKNIALVSPQGDIIGSLRSVEIYKHNKEERIARTWGTTSPGLPYVEEHITPSGNWLIGGDLEVFQXXKYNDGLDHYRLSPKQLRKEFDNRKADAVFAFQLRNPVHNGHALLMNDTRKRLLEMGYKNPILLLHPLGGFTKADDVPLDVRMEQHSKVLEDGVLDPETTIVSIFPSPMHYAGPTEVQWHAKARINAGANFYIVGRDPAGMGHPTEKRDLYDPDHGKKVLSMAPGLEKLNILPFRVAAYDTVEKKMAFFDPTRAKEFLFISGTKMRTYARTGESPPDGFMCPSGWNVLVKYYESLQESDDSSKQQQTVVSA

SEQ ID NO: 7497 - protein, 475 aa, Panicum virgatum
MATTHLLTPPRLHHPSPSPAARLRATASLAHPLLPSRPGLAAHHSRSPSPRHHRRRRAMSVVRSSLIDPDGGALVELVAPPDRLPVLRAEAGALPRVRLAPVDLQWAHVLAEGWASPLRGFMREAEYLQSLHFNCIRLPDGGLVNMSLPIVLAIGDADKERIGDKPDVALEGPDGGVVAILRRIEIYPHNKEERIARTWGTTAPGLPYVDEAIASAGNWLIGGDLEVLEPIKYNDGLDHYRLSPRQLRNEFDKRGADAVFAFQLRNPVHNGHALLMNDTRRRLLEMGYKNPILLLHPLGGYTKADDVPLPVRMEQHSKVLEDGVLDPETTIVSIFPSPMHYAGPTEVQWHAKARINAGANFYIVGRDPAGMGHPTEKRDLYNPDHGKKVLSMAPGLEKLNILPFKVAAYDTVAKKMAFFDPSRSQDFLFISGTKMRTFAKNGENPPDGFMCPGGWKVLVDYYNSLQAEEVTPVPV

SEQ ID NO: 7498 - protein, 474 aa, Oryza sativa
MATTTHLHLPNPIPPRLHASPPARLRASASLAHPRLLSGLRLAAARPRPRHGRRAMSVTVRSSLIDPDGGALVDLVAAPERRAALRGEAEALPRVRLAAVDVEWAHVLAEGWASPLRGFMREHEYLQSLHFNCIRLPDGAGVVNMSLPIVLAIGDREKEEIGSSPDVALHGPDGAVLAILRRVEIYPHNKEERIARTWGTTAPGLPYVDEAIAQAGNWLIGGDLEVIEPIKYNDGLDHYRLSPQQLRNEFDKRGADAVFAFQLRNPVHNGHALLMNDTRRRLLEMGFKNPILLLHPLGGFTKADDVPLPVRMEQHSKVLEDGVLDPETTIVSIFPSPMHYAGPTEVQWHAKARINAGANFYIVGRDPAGMGHPTEKRDLYNPDHGKKVLSMAPGLEKLNILPFKVAAYDTVAKKMAFFDPSRSKDFLFISGTKMRAFAKSGENPPDGFMCPGGWKVLVDYYNSLQTEEAAVATV

SEQ ID NO: 7499 - protein, 480 aa, Brachypodium distachyon
MAVHLLTAPRLHSSSSSPAPLPRRRATASAPLAHPLLLLHSRLRLATTAAVSRPVPRARRAMSAIRSSLIDPDGGALVDLVAPADRRASLRAEAEALPRVGLAPIDVEWAHVLAEGWASPLRGFMREHEYLQCIHFNSLRLPAGGVVNMSLPIVLAIGDREKDNIGDTPDVALAGPDGQLLAILRRVEIYPHNKEERIARTWGTTAPGLPYVDEAITPAGNWLIGGDLEVLEPIKYNDGLDHYRLSPQQLRDEFDKRGADAVFAFQLRNPVHNGHALLMNDTRRRLLEMGFKNPILLLHPLGGFTKADDVPLPVRMEQHSKVLEDGVLDPETTIVSIFPSPMHYAGPTEVQWHAKARINAGANFYIVGRDPAGMGHPTEKRDLYNPDHGKKVLSMAPGLEKLNILPFKVAAYDTVAKKMAFFEPSRSQDFLFISGTKMRTFAKTGENPPDGFMCPGGWKVLVDYYNSLQTEEAAIAAAIV

SEQ ID NO: 7500 - protein, 475 aa, Zea mays
MATTHLLTPPRVHHPSPSASSSVARVRATASLAHPLHLCRLRLAAPRSRSPSPRHGRRAMSVRSSLIDPDGGALVELVAPPDRLPALRAEAEALPRVRLAPVDLQWAHVLAEGWASPLRGFMREHEYLQSLHFNCVRLPDGGLVNMSLPIVLAIGDADKEQIGGKPDVALQGPDGGVVAILRRVEIYPHNKEERIARTWGTTAPGLPYVDEAIASAGNWLIGGDLEVLEPIKYNDGLDHYRLSPRQLRKEFDKRGADAVFAFQLRNPVHNGHALLMNDTRRRLLEMGYKNPILLLHPLGGYTKADDVPLPVRMEQHSKVLEDGVLDPETTIVSIFPSPMHYAGPTEVQWHAKARINAGANFYIVGRDPAGMGHPTEKRDLYNPDHGKKVLSMAPGLEKLNILPFKVAAYDTVAKEMAFFDPSRSQDFLFISGTKMRTYAKTGENPPDGFMCPGGWKVLVDYYNSLQAEEATPVPV

SEQ ID NO: 7501 - protein, 333 aa, Brachypodium distachyon
MAVHLLTAPRLHSSSSSPAPLPRRRATASAPLAHPLLLLHSRLRLATTAAVSRPVPRARRAMSAIRSSLIDPDGGALVDLVAPADRRASLRAEAEALPRVGLAPIDVEWAHVLAEGWASPLRGFMREHEYLQCIHFNSLRLPAGGVVNMSLPIVLAIGDREKDNIGDTPDVALAGPDGQLLAILRRVEIYPHNKEERIARTWGTTAPGLPYVDEAITPAGNWLIGGDLEVLEPIKYNDGLDHYRLSPQQLRDEFDKRGADAVFAFQLRNPVHNGHALLMNDTRRRLLEMGFKNPILLLHPLGGLQKLMMSHCLSEWNNTARSWKMESLILRLP

SEQ ID NO: 7502 - protein, 245 aa, Raphanus sativus
MGLIIRLSPKQLRKEFDNRKADAVFAFQLRNPVHNGHALLMNDTRKRLLEMGYKNPVLLLHPLGGFTKADDVPLDVRMEQHSKVLEDGVLDPETTIVAIFPSPMHYAGPTEVQWHAKARINAGANFYIVGRDPAGMGHPSEKRDLYDPDHGKKVLSMAPGLEKLNILPFRVAAYDTVEKKMAFFDPTRAKEFLFISGTKMRTYARTGESPPDGFMCPSGWNVLVKYYESLQESDESSKQQAVVSA

SEQ ID NO: 7503 - protein, 360 aa, Picea glauca
GLHETGRVSPTLHFNSLRLQDGSVVNMSVPIVLAIDDLQKEAIGHSNDVALLDPNGKFVAILRNIEIYKHNKEERIARTWGTTAPGLPYVEEAIAHAGNWLIGGDLEFLERITYNDGLDQYRLSPKQLREEFEKRKADAVFAFQLRNPIHNGHALLMTDTRRRLLEMGYKNPILLLHPLGGFTKSDDVPLSWRMRQHDKVLEEGVLDPETTVLAIFPSAMHYAGPTEVQWHAKARINAGADFYIVGRDPAGMSHPKEKRDLYDPDHGKMVLSMAPGLEKLNILPFRVAAYDKKLNKMAFFDPSRPDDFLFISGTKMRNLAKNGENPPDGFMCPGGWKVLVEYYQSLKSLEINQLKEVIAV

SEQ ID NO: 7504 - protein, 192 aa, Solanum melongena
MASLKLLLLAPFLSLFYFSITADSTPLPTSFIKSSCKLTTYPQVCVSSLAGYAPTIKRSPQQLAQIALSVSLDKAQSAQTFITKLCKFKGLKPREYAALKDCLEEMSDTIDRISKSVKELKSAQRGKDFQWHMSNIETWISAALTNENTCGDGFSGRALNGRIKTSIRARVSHVAQVTSNALALINQFAAKH

SEQ ID NO: 7505 - protein, 206 aa, Brassica juncea
PPVYPPTKAPVKPPVKPPVKPPVSPPAKPPVKPPVYPPTKAPTKPPTKPPVKPPVSPPAKPPVKPPVYPPEFNRSLVAVQGTVFCKSCKYASYDSLTGAKPVEGAKVRLVCKSKKNIVAETETDKNGYFLLLAPKTVTNFGFRGCRAYLVKSKDYKCNKVSKLFGGDVGAVLKPVKTPGKSSVVINKLTYGVFNVGPFAFDPVCPK

SEQ ID NO: 7506 - protein, 164 aa, Brassica juncea
TKAPTKPPTKPPVKPPVSPPVKPPVYPPKFNRSLVAVQGTVFCKSCKYAPYDSLTGAKPVEGAVVRLLCKGKKNIVAETTTDKNGYFFLLGPKTVTNYGFRGCRAYLVKSKDYKCNKVSKLFGGDVGAELKPVKTPGKSYVVINKLIYGVFNVGPFAFNPVCPK

SEQ ID NO: 7507 - protein, 206 aa, Raphanus sativus
APVKPPVKPPVKPPVSPPAKPPVKPPFYPPTKAPVKPPTKAPVKPPVSPPAKPPVSPPAKPPVRPPVYPPKFNRSLVAVQGTVFCKSCQYASSDSLIGAKPVEGAVVRLLCKSKKNIVAETKTDKNGYFLLLGPKTVTNYGFRGCRVYLVKSKDYKCNKVSKLFGGDVGAVLKPEKRKGKSAVVINQLIYGIFNVGPFAFDPVCPK

SEQ ID NO: 7508 - protein, 228 aa, Brassica juncea
FKAPVSPPAKPPVKPPVYPPTKAPVKPPVKPPVKPPVSPPAKPPVKPPVYPPTKAPVKPPTKAPVKPPVSPPAKPPVSPPAKPPVRPPVYPPKFNRSLVAVQGTVFCKSCQYASSDSLIGAKPVEGAVVRLLCKSKKNIVGETKTDKNGYFLLLGPKTVTNYGFRGCRVYLVKSKDYKCNKVSKLFGGDVGAVLKPEKRKGKSAVVINQLIYGIFNVGPFAFDPVCSK

SEQ ID NO: 7509 - protein, 380 aa, Brassica napus
DHKAKYERNMGFLGKSVLLSILAIWFFTSCAFTEEVNHVTQTPSSAPAPSPYHHGHHHPHPPHHHHPHPHPPAKAPVKPPVSPPSKPPVKTPVYPPTKSPVKPPTKPPVKAPVSPPAKPPVKPPVYPPTKAPVKPPVKPPVKPPVSPPAKPPVKPPVYPPTKAPVKPPVKPPVKPPVSPPAKPPVKPPVSPPAKPPVKPPVYPPTKAPVKPPTKAPVKPPVSPPTKPPVSPPAKPPVRPPVYPPKFNRSLIAVQGTVFCKSCQYASSDSLIGAKPVEGAVVRLLCKSKKNVVAETKTDKNGYFLLLGPKTVTNYGFRGCRVYLVKSKDYKCNKVSKLFRGDVGAVLKPEKRKGKSAVVINQLIYGIFNVGPFAFDPVCPK

SEQ ID NO: 7510 - protein, 156 aa, Brassica juncea
VKPPVSPPAKPPVKPPVYPPEFNRSLVAVQGTVFCKSCKYASYDSLTGAKPVEGAKVRLVCKSKKNIVAETETDKNGYFLLLAPKTVTNFGFRGCRAYLVKSKDYKCNKVSKLFGGDVGAVLKPVKTPGKSSVVINKLTYGVFNVGPFAFDPVCPK

SEQ ID NO: 7511 - protein, 325 aa, Arabidopsis lyrata
MDYQYIKLLDSFREDGSLNLSDNPLRSIRYEVDNGGYDKREFKAVFTNKRSREDRNTIRVTKKNVEPKPPHVQASTEKVTKEAGFKLRRRESLVSQKSVEAMLITSHVRRNSQHNNGDASEKENFEDDIVLDEVYRSYLKRLVENSKSSRTNPEKEIKVKCEEDHTVSLSDSDSDIIVVGDCPFLEEEDSPFVPSKSYKVIDLDEESSDQRNSWFRKEIMNVLKQPYTVTELKELHKEASVHGVSSRHIELRDGTEFSFPTNKKKPSYLDRYPDFKKQYLDSLREKDERKALNLLRGFIFYITNVVRDDAFKPWLDQECLKIRCV

SEQ ID NO: 7512 - protein, 320 aa, Saccharum officinarum
MASASSNAKQSLYPDVDQSHPDLNTPFFSAPTTSTTTGNSLYPTVDPNELAENLFPETAEEEAAPPPPTTEETIVAVPGAQLHLVDPDRSLDLGAGTLSIARLRQGDHSVAVLARLIPGKPHHRRGLFRLFSSGRSEGGAEQEPVQWPLTRDVAAVKLDPAHYFFSLHVPHTDHPDDKDDAEDAEADAEAALSYGLTVVGKGQEKVLEELDRVLEEYTTFSVKQVEAAAKEKSEVMDARAVAEITPEEAVGDKKEVVEEKSAAFWTTIAPNVDDYSSYVAKLIARGSGQLVRGIIWCGDITAEGLRGGEEVVKNNVGPSA

SEQ ID NO: 7513 - protein, 238 aa, Panicum virgatum
MASASSNAKQSLYPSVDQSHPDLNTPFYSAPTTSTSASAAGGSLYPTVDPNELAENLFPETAEEDAAPPPPTTEETVVAVPGAQLHLVDPDRSLDLGAGTLSVVRLRQGDHSVAILARLTPEKQHQRRGLFRLFSSGRSGGDGAEQEPVQWPLTRDVAAVKLDPAHYFFSLHVPHTDHPDDKDDAEDGADEAEAALSYGLTVAGKGQEKVLEKLDRVLEEYTTFSVKQWRRRRKRSRR

SEQ ID NO: 7514 - protein, 312 aa, Nicotiana benthamiana
  misc_feature (288)..(288): Xaa can be any naturally occurring amino acid
MASLNPNSSRTPMYPQVVIDQHTPFPPSSSSRQNLYPTIDMNDLVENLFPENDQSTPNEQHYSPSAPLETLEETLLTIPGSILHLIDAHYSVELAAGDLSVHRLRQDNSVVAVLVRVGNEIQWPLTKDLAAVKLDDSRYFFSFQAPKADESDKDSSANDLANESLNYGLTIASKGQEKLLKDLDSILENYSNFAVQKVEEKAAAVLGGLVAKELSPEDLKSEKKKEVLEERCAAYWTTLAPNVEEYNASAAKYVASGSGHLIKGILWCGDVTADRLKWGNEVLKNRFXTGSKTEVSPETLRESKGLESNKDD

SEQ ID NO: 7515 - protein, 169 aa, Unknown
  Sequence found in Organisms: Solanum tuberosum, Solanum phureja
MASQSSNPQSVYDFTVKDAKGKDVDLSIYKGKVLIIVNVASQCGLTNSNYTDMTELYKKYKDQGLEILAFPCNQFGGQEPGSIEDIQQMVCTRFKAEYPIFDKVDVNGDNAAPLYKFLKSSKGGFFGDGIKWNFSKFLIDKEGHVVDRYSPTTTPASMEKDIKKLLGVA

SEQ ID NO: 7516 - protein, 169 aa, Solanum melongena
MAGQSSNPQSVYDFTVKDAKGKDVDLSIYKGKVLIIVNVASQCGLTNSNYTDMTELYRKYKDQGLEILAFPCNQFGGQEPGSIEDIQQMVCTRFKAEYPIFDKVDVNGDNAAPLYKFLKSSKGGFFGDGIKWNFSKFLIDKEGRVVDRYSPTTSPASMEKDIKKLLGVA

SEQ ID NO: 7517 - protein, 169 aa, Capsicum annuum
MASQSNKPQSVYDFTVKDAKGKDVDLSIYKGKVLIIVNVASQCGLTNSNYTDMTELYRKYKDKGLEILAFPCNQFGGQEPGSIEDIQQMVCTRFKAEYPIFDKVDVNGDNAAPLYKFLKSSKGGFFGDGIKWNFSKFLIDKEGNVVDRYSPTTSPASMEKDIKKLLGVA

SEQ ID NO: 7518 - protein, 169 aa, Nicotiana tabacum
MASQSSKPQSIYDFTVKDAKGNDVDLSIYKGKVLIIVNVASQCGLTNSNYTDMTEIYKKYKDQGLEILAFPCNQFGGQEPGSIEEIQNMVCTRFKAEYPIFDKVDVNGDNAAPLYKFLKSSKGGFFGDSIKWNFSKFLVDKEGNVVDRYSPTTTPASMEKDIKKLLGVA

SEQ ID NO: 7519 - protein, 170 aa, Gossypium hirsutum
MASQSSKPQSIYDFTVKDAKGNDVDLSIYKGKVLIIVNVASQCGLTNSNYTDLTEIYKKYKDQGLEILAFPCNQFGGQEPGSIEESIQNMVCTRFKAEYPIFDKVDVNGDNAAPLYKFLKSSKGGFFGDSIKWNFSKFLVDKEGNVVDRYSPTTTPASMEKDIKKLLGVA

SEQ ID NO: 7520 - protein, 169 aa, Petunia hybrida
MASQSSNPQSIYDFTVKDAKGNDVDLSIYKGKVLIIVNVASQCGLTNSNYTDLSELYKKYKDQGLEILAFPCNQFGGQEPGSVEDVQQMVCTRFKAEFPIFDKVDVNGDNAAPVYKFLKSSKGGFFGDGIKWNFSKFLVDKEGNVVDRYAPTTAPASMEKSIKKLLGIA

SEQ ID NO: 7521 - protein, 171 aa, Petunia hybrida
MASQSNNPQSIYDFTVKDAKGNDVDLSAYKGKVLIIVNVASQCGLTNSNYTELTDLYSKYKDKGLEILAFPCNQFGSQEPGNIEEIQQTVCTRFKAEFPIFDKVNVNGDNAAPLYKFLKSSKGSLFGDGIKWNFSKFLVDKEGNVVDRYSPTTSPSSMEKDIKKLLGVAQL

SEQ ID NO: 7522 - protein, 158 aa, Petunia hybrida
MASQSSNPQSIYDFTVKDAKGNDVDLSIYKGKVLIIVNVASQCGLTNSNYTDLSELYKKYKDQGLEILAFPCNQFGGQEPGSVEDVQQMVCTRFKAEFPIFDKVDVNGDNAAPVYKFLKSSKGGFFGDGIKWNFSKFLVDKEGNVVDRYAPTTAPASM

SEQ ID NO: 7523 - protein, 169 aa, Linum usitatissimum
MASNSKAPQSIYDFTVKDARGNDVDLSTYKGKVLLIVNVASQCGLTNSNYTELTELYKKYKDQGLEILAFPCNQFGSQEPGSNEQIMEFACTRFKAEYPIFDKVDVNGNNAAPIYKFLKSSKGGLFGDGIKWNFAKFLINKEGQVVDRYAPTTSPLSFEKDVKKLLGVA

SEQ ID NO: 7524 - protein, 168 aa, Rhizophora mangle
MASQSNVQSVYDFTVKDATGKDVDLSIYKGKVLLIVNVASQCGLTNSNYTELTELYQKYKDQGLEILAFPCNQFGAQEPGDNEQIVEFVCTRFKAEFPIFDKVDVNGNSAAPIYKYLKSSKGGLFGDSIKWNFTKFLVDKEGNVVERYAPTTSPLSIEKDVKKLMGVA

SEQ ID NO: 7525 - protein, 168 aa, Manihot esculenta
MANQSEPKSVHDFTVKDARGNDVDLSIYKGKVLVIVNVASQCGLTNSNYAELTQLYHKYKDQGLEILAFPCNQFGSQEPGTNEEILEFACTRFKAEYPIFDKVDVNGNNAAPLYKFLKSSKGGTFGDGIKWNFSKFLVDKDGNVVDRYAPTTSPLSMEKDVKKLLGIA

SEQ ID NO: 7526 - protein, 169 aa, Coffea canephora
MATQSSAPQSVHDFTVKDARGNDVDLSQYKGKVLLIVNVASQCGLTNKNYTELTKLYEQYKDQGLEILAFPCNQFGSQEPGTNEEIQQFACTRFKAEYPIFDKVDVNGSNAAPLYKFLKSSKGGLFGDSIKWNFSKFLVDKEGHVVDRYAPTTSPLSIEEDVKKLLEKA

SEQ ID NO: 7527 - protein, 168 aa, Euphorbia esula
MAGQSGAKSVYDFTVKDAKGNDVDLSIYKGKVLLIVNVASQCGLTNSNYTELTELYQKYKGQGLEILAFPCNQFGSQEPGTNEQIMEFACTRFKAEYPIFDKVDVNGNNAAPLYKYLKSSKGGVFGDGIKWNFSKFLVDKEGNVVDRYAPTTSPLSIEKDVKKLLAIA

SEQ ID NO: 7528 - protein, 170 aa, Prunus persica
MASQSGSGSKSIHDFTVKDAKGKDVDLSIYKGKVLLIVNVASQCGLTNSNYTELSQLYEKYKNQGLEILAFPCNQFGAQEPGSNDEIVEFACTRFKAEYPIFDKVDVNGDNAAPIYKFLKSSKGGLFGDGIKWNFSKFLVDKEGNVVDRYAPTTTPLSIEKDVKKLLGVA

SEQ ID NO: 7529 - protein, 169 aa, Coffea canephora
  misc_feature (145)..(145): Xaa can be any naturally occurring amino acid
MATQSSAPQSVHDFTVKDARGNDVDLSQYKGKVLLIVNVASQCGLTNKNYTELTKLYEQYKDQGLEILAFPCNQFGSQEPGTNEEIQQFACTRFKAEYPIFDKVDVNGSNAAPLYKFLKSSKGGLFGDSIKWNFSKFLVDKEGHXVDRYAPTTSPLSIEEDVKKLLEKA

SEQ ID NO: 7530 - protein, 166 aa, Actinidia deliciosa
MASQSQKPQSVHEFTVKDAKGNDVDLSLYKGKVLLIVNVASQCGLTNSNYTDLSKLYDKYKDQGLEILAFPCNQFGGQEPGNNEQIMEFACTRFKAEFPIFDKVDVNGEKAAPIYKFLKSSKGGFFGDSIKWNFSKFLVDKDGNVVDRYAPTTSPLSIEKDIKKLL

SEQ ID NO: 7531 - protein, 166 aa, Gossypium hirsutum
MASQSSKGSVHDFTVKDARGNDVDLSIYKGKVLLIVNVASQCGLTNSNYTELSKLYEQYKDQGFEILAFPCNQFGGQEPGNNEQILEFACTRFKAEYPIFDKVDVNGEKAAPVYKFLKSSKGGLFGDSIKWNFSKFLVDKEGHVVDRYAPTTSPLSIEKDIKKLLA

SEQ ID NO: 7532 - protein, 168 aa, Setaria italica
MAAASSTTSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGNNAAPIYKFLKSSKGGLFGDSIKWNFSKFLVDKEGRVVDRYAPTTSPLSIEKDIKKLLGSS

SEQ ID NO: 7533 - protein, 168 aa, Manihot esculenta
MASQSQPKSVHDFAVKDARGNDVDLSIYKGKVLLIVNVASQCGLTNSNYTELTQLYQKYKDQGLEILAFPCNQFGSQEPGTNEEIVEFACTRFKAEYPIFDKIDVNGNNAAPLYKFLKSSKGGIFGDSIKWNFSKFLVDKDGNVVDRYAPTTSPLSIEKDVKKLLGIA

SEQ ID NO: 7534 - protein, 168 aa, Ricinus communis
MAAPSEPKSVHDFTVKDARGNDVDLSIYKGKALLIVNVASQCGLTNSNYTELTQLYQKYKDQGLEILAFPCNQFGSQEPGTNEQIMEFACTRFKAEYPIFDKVDVNGNNAAPIYKFLKSSKGGLFGDGIKWNFSKFLVDKDGNVVDRYAPTTSPLSIEKDVKKLLGVA

SEQ ID NO: 7535 - protein, 168 aa, Unknown
  Sequence found in Organisms: Sorghum bicolor, Cenchrus ciliaris, Saccharum officinarum
MAAASSATSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGNNAAPIYKFLKSSKGGLFGDSIKWNFSKFLVDKEGRVVDRYAPTTSPLSIEKDIKKLLGSS

SEQ ID NO: 7536 - protein, 168 aa, Vitis vinifera
MASQSSPQSVHSFTVKDARGNDVDLSIYKGKALLIVNVASQCGLTNSNYTELHQLYEKYKDQGLEILAFPCNQFGAQEPGSNEEIEKFVCTRFKAEYPIFDKIDVNGDSAAPLYKFLKSSKGGLFGDNIKWNFSKFLVDKDGKVVDRYAPTTTPLSIEKDIKKLLGIS

SEQ ID NO: 7537 - protein, 169 aa, Mimulus guttatus
MASQSSQPQSVHDFTVKDARGNDVDLSTYKGKVLLIVNVASQCGLTNSNYTELAKLYGKYKDQGLEILAFPCNQFGAQEPGSNEEIQEFACTRFKAEYPIFDKVEVNGSNATPLYKYLKSVKGGLFGDGIKWNFSKFLVNKEGRVVDRYAPTTSPLSIEKDIKKLLEKA

SEQ ID NO: 7538 - protein, 168 aa, Populus trichocarpa
MASQSSPQSAHDFTVKDAKGNDVDLSIYKGKVLLIVNVASQCGLTDSNYTELTQLYAKYKDQGLEILAFPCNQFGSQEPGSSEEIVEFACTRFKAEYPIFDKVEVNGNNAAPIYKYLKSSKGGLFGDNIKWNFSKFLVDKEGKVVDRYAPTTSPLSIEKEVKKLLGIA

SEQ ID NO: 7539 - protein, 168 aa, Populus trichocarpa
MASQSSAQSVHDFTVKDARENDVDLSIYKGKVLLIVNVASQCGLTNSNYTELTQLYDKYRDQGLEILAFPCNQFGSQEPGNNEQIVEFACTRFKADYPIFDKVDVNGKNAAPIYKFLKSSKGGLFGDSIKWNFSKFLVDKDGKVVDRYAPTTSPLSIEKDVKKLLGIA

SEQ ID NO: 7540 - protein, 168 aa, Pseudoroegneria spicata
MAAASSATSVHDFTVKDASGKDVDLSVYKGKVLLIVNVASQCGLTNSNYTELSQLYPKYKDQGFEILAFPCNQFGGQEPGSNEEIVQFACTRFKAEYPIFDKVDVNGNNVSPLYKFLKSSKGGLFGDSIKWNFSKFLVDKEGHVVDRYAPTTSPLSIEKDIKKLLGSS

SEQ ID NO: 7541 - protein, 168 aa, Panicum virgatum
MAAASSATSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGNNATPLYKFLKSSKGGLFGDSIKWNFSKFLVDKEGRVVDRYAPTTSPLSIEKDIKKLLGSS

SEQ ID NO: 7542 - protein, 168 aa, Panicum virgatum
MAAASSATSVHDFTVKDASGKDVDLSTYKGKVLLIVNVASQCGLTNSNYTELAQLYEKYKDQGFEILAFPCNQFGGQEPGTNEEIVQFACTRFKAEYPIFDKVDVNGSNATPLYKFLKSSKGGLFGDSIKWNFSKFLVDKEGRVVDRYAPTTSPLSIEKDIKKLLGSS

SEQ ID NO: 7543 - protein, 156 aa, Panax ginseng
MATQSSNPQSVHDFTVKDARGNEVELSKYKGKVLLIVNVASQCGLTNSNYTELAKLYEKYKDQGLEILAFPCNQFGAQEPGTNEEIVEFACTRFKAEYPIFDKVDVNGPNAAPIYKFLKSSKGGLFGDDIKWNFAKFLVDKDGKVCRSICSHNLSS

SEQ ID NO: 7544 - protein, 210 aa, Brassica juncea
GALSMTNQIKATSFSYCLVDRDSGKSSSLDFNSVQAGTGDATAPLLRNSKIDTFYYVGLSGFSVGGQQVSIPSSVFAVDASGAGGVILDCGTAVTRLQTQAYNSLRDAFVKLTANLKRGTSSISLFDTCYDFSSLSTVKVPTVAFHFTGGKTLNLPAKNYLIPIDDAGTFCFAFAPTSSSLSIIGNVQQQGTRITYDLANHLIGLSANKC

SEQ ID NO: 7545 - protein, 270 aa, Brassica napus
RSDKCLYQVSYGDGSFTVGDYATDTVTFGTNGKVNDVALGCGHDNEGLFTGAAGLLGLGGGALSMTNQIKATSFSYCLVDRDSGKSSSLDFNSVQAGTGDATAPLLRNSKIDTFYYVGLSGFSVGGQQVSIPSSVFAVDASGAGGVILDCGTAVTRLQTQAYNSLRDAFVKLTANLKKGTSSISLFDTCYDFSSLSTVKVPTVAFHFTGGKSIDLPAKNYLIPVDDAGTFCFAFAPTSSSLSIIGNVQQQGTRITYDLANNLIGLSANQC

SEQ ID NO: 7546 - protein, 263 aa, Brassica oleracea
QVSYGDRSFTVGDYATDTVTFGTNGKVNDVALGCGHDNEGLFTGAAGLLGLGGGALSMTNQIKATSFSYCLVDRDSGKSSSLDFNSVQAGTGDATAPLLRNSKIDTFYYVGLSGFSVGGQQVSIPSSVFAVDASGAGGVILDCGTAVTRLQTQAYNSLRDAFVKLTANLKKGTSSISLFDTCYDFSSLSTVKVPTVAFHFTGGKSIDLPAKNYLIPVDDAGTFCFAFAPTSSSLSIIGNVQQQGTRITYDLANNLIGLSANQC

SEQ ID NO: 7547 - protein, 198 aa, Brassica oleracea
SFSYCLVDRDSGKSSSLDFNSVQVGAGDATAPILRNSKIDTFYYVGFTGFSVGGQQVSIPSSAFAVDASGTGGVILDCGTAVTRLQTQAYNSLRDAFVKLTANLKRGTSSISLFDTCYDFSSLSTVKVPTVAFHFTGGKTLNLPAKNYLIPIDDAGTFCFAFAPTSSSLSIIGNVQQQGTRITYDLANHLIGLSANKC

SEQ ID NO: 7548 - protein, 259 aa, Brassica rapa
MAFARFFSLLTVITLSLFLLASNASSRSLSTPHKTTVLNVVSSLQQTQHILSIDPTTTTRPEFGSKSIPFFLNSSSPLTLELHSRDTLLAPHHKDYKSLVLSRLERDSSRVAGIAAKVRFSVEGVDRSDLKPVYNDETMYNPEELTTPVVSGASQGSGEYFSRIGVGTPAKEMYMVLDTGSDVNWLQCKPCSDCYEQSDPVFDPAESSTYKPLTCAAPQCASLEVSTCRSNKCLYQVSYGAGLSRWRVRDRYGDVWRLG

SEQ ID NO: 7549 - protein, 493 aa, Cleome gynandra
MAFRLSFSLLSLFLFFVTTSFSRSLSPSSHTTILDVVSSLQQTHQVLSLDPSRTTLTRRPDSESIPVFRNSSSFSLELHSRETLVQSQHRDYRSLVLARLERDSARVAGITAKVRLAVEGVDRSKLQPVYDADTRIQPEDLSTPIVSGASQGSGEYFSRIGIGTPPKEMFMVLDTGSDVNWIQCQPCSDCYQQSDPVFNPASSSSYSSLSCASPQCSALEVSACRADKCLYQVSYGDGSFTVGEFATETVSFGNSGKVNGVALGCGHDNEGLFVGSAGLLGLGGGALSLTSQIKAKSFSYCLVDRDSGRSSSLDFNSAQLGGQVTAPLLRNHKIDTFYYVGLTGFSVGGHPVAIPPSVFAVDESGSGGVIVDCGTAVTRLQTQAYNSLRDAFARLTSHLKSASSSISLFDTCYDFSSLSTVRVPTVALHFAGGKSLELPAKNYLIPVDSAGTFCFAFARTSTPLSIIGNVQQQGTRVSFDLANNLVGFSPNKC

SEQ ID NO: 7550 - protein, 104 aa, Brassica napus
MLSAVQSQMGALDAPYDDLSSLFETGGAKGLTGDLVEKIPKLTITDNNNTDASENRDSCSVCLQDFQLGETVRSLPHCHHMFHLPCIDKWLLRHGSCPMCRHDL

SEQ ID NO: 7551 - protein, 232 aa, Cajanus cajan
MEFVPNPCPLRSSSFVNLVERVKQLGTLAVSAVIGNIFSAILTFCFALVGTLLGALTGALIGQETESGFIRGAAVGAISGAVFSIEVFESSLVLWQSDESGIGCVLYLIDVIASLLSGRLVRERIGPAMLSAVQSQMGAVENSFDEVQNIFDTGGAKGLSGDLVEKIPKIKITTDNNVDASGDRVSCSVCLQDFQLGETVRSLPHCHHMFHLPCIDKWLFRHGSCPLCRRDL

SEQ ID NO: 7552 - protein, 232 aa, Vigna unguiculata
MEFVPNPCPLRSSSLGNLVERVKQLGTLAVSAVIGNIFSAILTFCFALVGTLLGALTGALIGQETESGFIRGAAVGAISGAVFSIEVFESSLVLWQSDESGIGCVLYLIDVIASLLSGRLVRERIGPAMLSAVQNQMGAVETSFDEVQNIFDTGGAKGLSGDLVEKIPKIKITTDNNFDASGDRVSCSVCLQDFQLGETVRSLPHCHHMFHLPCIDKWLFRHGSCPLCRRDL

SEQ ID NO: 7553 - protein, 122 aa, Brassica juncea
IVSLISGRLVRERIGPAMLSAVQSQMGPADAATFDDLSSIFDTGGSKGLTVDVVDKIPKIKITGGNNLDASGNKDSCSVCLQDFQLGETVRSLPHCHHMFHLPCIDNWLLRHGSCPMCRRDL

SEQ ID NO: 7554 - protein, 235 aa, Manihot esculenta
MEYYPYPSRFSMPLLPSFGDFVGKVKEVCNFAVSAIIGNIFSAIFTFFFALVGTLLGAMTGALIGQETESGFVRGAAVGAISGAVFSIEVFESSLLLWQSDESGIGCLLYLIDVIASLLSGRLVRERIGPAMLSAVQSQMGAVETSFDEVQNIFDTGGAKGLPGDSVEKIPKIKITSNNNGDASGERVACSVCLQDFQLGETVRSLPHCHHMFHLPCIDKWLLRHASCPLCRRDL

SEQ ID NO: 7555 - protein, 179 aa, Heritiera littoralis
VKDFCNFAVSAIIGNIFSAILTFFFALVGTLLGAMTGALIGQETESGFVRGAAVGAISGAVFSIEVFESSLVLWQSDESGIGCLLYLIDVIASLLSGRLVRERIGPAMLSAVQSQMGAAETTYYEVHNIFDTGGAKGLDGDLVEKIPKIIITNNNNVDASWGESFMFSLPSGLSAWRDS

SEQ ID NO: 7556 - protein, 235 aa, Prunus persica
MDFIAHPSRFSSSSSFSFGNFFERIKEFCNFAVSAILGNIFSAIFTFFFALVGTMLGAMTGALIGQETESGFVRGAAVGAISGAVFSIEVFESSLILWQSDESGIGCLLYLIDVIASLLSGRLVRERIGPAMLSAVQSQMGAVESSFDEIPNIFDTGGSKGLPGDSVEKIPKIIITSNNNVDASGEKVSCSVCLQDFQLGETVRSLPHCHHMFHLPCIDKWLLRHGSCPLCRRDL

SEQ ID NO: 7557 - protein, 232 aa, Phaseolus coccineus
MDFVPNPCPLPSSSIGNLVERVKQLGTLAVSAVIRNIFSAILTFCFALVGTLLGALTGALIGQETESGFIRGAAVGAISGAVFSIEVFESSLVLWQSDESGIGCVLYLIDVIASLLSGRLVRERIGPAMLSAVQNQMGAVETSFDEVQNIFDTGGAKGLSGDLVEKIPQIKITTDNNIDASGDRVSCSVCLQDFQLGETVRSLPHCHHMFHLPCIDKWLFRHGSCPLCRRDL

SEQ ID NO: 7558 - protein, 235 aa, Castanea mollissima
MDFIAYPSLFSSSSSSSFGNFIERVREACHFAVSAIIGNIFSAIFTFFFALVGTLLGAMTGALIGQETESGFVRGAAVGAISGAVFSIEVFESSLVLWQSDESGIGCVLYLIDVIASLLSGRLVRERIGPAMLSAVQSQMGAVDVSFDEIPNIFDTGGAKGLPGDSVEKIPKIIITGNNNVDASGDRVSCSVCLQDFQLGETVRSLPHCHHIFHQPCIDKWLLRHGSCPLCRRDL

SEQ ID NO: 7559 - protein, 235 aa, Vitis vinifera
MEFYAYPSHSYSWPSFSFANLVGRVRDFFSFAFSAILGNVFSAIFTFFFALVGTMLGAMTGALIGQETESGFVRGAAVGAISGAVFSIEVFESSLVLWQSDESGIGCLLYLIDVIVSLLSGRLVRERIGPAMLSAVQSQMGAVEVSYDEAPNIFDTGGAKGLPGDSVEKIPKITITSDNNGDASGEKVSCSVCLQDFQLGETVRSLPHCHHMFHLPCIDKWLLGHGSCPLCRRDL

SEQ ID NO: 7560 - protein, 347 aa, Arabidopsis thaliana
MSYEKELAAAKKAVTLAARLSQEVQKTLLQSQVWKKSDRSPVTAADYGSQAVVSLVLERELQPDKLSLVAEEETGDLRKNGSEAFLEDIAKLVKDTLASEESYTSSPLSTDDVLNAIDCGKSEGGCKGSHWVLDPIDGTRGFVRGEQYAVGLALLVEGKVVLGVMACPNLPLASAVCATDNSSQEDVGCLFFATTGSGTYVQSLKGNSLPQKVQVSSNENLDEAKFLESYHKPIPIHGTIAKKLGIKALPVRIDSQAKYAALSRGDAEIYLRFTLNGYRECIWDHAPGSIITTEAGGVVCDATGKSLDFSKGKYLAHKTGIIVTTKKLKPWILKAVRESIEEENLYF

SEQ ID NO: 7561 - protein, 506 aa, Brassica oleracea
QEEAEEKSILEKVKAGMTEEDLAELARATEELRLKQETPDPPEALRCVPSLNLSDIPKEPTYVPTEVGDINGVKVLRHDLFTNDIVYAEVVFDMGSLKHELLPLVPLFCQSLMEMGTKDLSFVQLNQLIGRKTGGISVYPLTSSVRGKDEPCTKIIVRGKSMAGRADDLFNLMNCLLQEVQFTDQQRFKQFVSQSIARMENRLRGSGHGVAAARMDAMLNIAGWMSEQMGGLSYLEFLRTLEKKVGEDWEGISSSLEEIRRSLLAKNGCIVNMTADGKSLTNIEKSLEKFLDLLPESPSGGLVTWDGRLPLRNEAIVIPTQVNYVGKAGNIYSTGYELDGSAYVISKHISNTWLWDRVRVSGGAYGGFCDFDSHSGVFSFLSYRDPNLLKTLDIYDGTGDFLRGLDVDQETLTKAIIGTIGDVDSYQLPDAKGYSSLMRHLLGVTDEERLRKREEILTTSLKDFKDFAEAIDVVRDNGVAVAVASAEDIDAANNARSNFFEVKKAL

SEQ ID NO: 7562 - protein, 385 aa, Brassica napus
FVQLNQLIGRKTGGISVYPLTSSVRGKAEPCSKFVVRGKSMAGRAEDLFNLMNCLLQEVQFTDQQRFKQFVSQSIARMENRLRGSGHGIAAARMDAMLNVAGWMSEQMGGLSYLEFLHTLAKKVDEDWEGISSSLEEIRRSLLARNGCLVNMTADGKSLTNIEKSVEKFLNLLPETPSGGLVTWDGRLPLRNEAIVIPTQVNYVGKAGNIYSTGYELDGSAYVISKHISNTWLWDRVRVSGGAYGGFCDFDSHSGVFSFLSYRDPNLLKTLDIYDGTGDFLRGLDVDQETLTKAIIGTIGDVDSYQLPDAKGYSSLMRHLLGVTDEERQRKREEILTTSLKDFKEFAEAIDVVREKGVAVAVASAEDIDAANQARSNFFEVKKAL

SEQ ID NO: 7563 - protein, 385 aa, Brassica napus
FVQLNQLIGRKTGGISVYPLTSSVRGKAEPCSKFVVRGKSMAGRAEDLFNLMNCLLQEVQFTDQQRFKQFVSQSIARMENRLRGSGHGIAAARMDAMLNVAGWMSEQMGGLSYLEFLHTLAKKVDEDWEGISSSLEEIRRSLLARNGCLVNMTADGKSLTNIEKSVEKFLNLLPETPSGGLVTWDGRLPLRNEAIVIPTQVNYVGKAGNIYSTGYELDGSAYVISKHISNTWLWDRVRVSGGAYGGFCDFDSHSGVFSFLSYRDPNLLKTLDIYDGTGDFLRGLDVDQETLTKAIIGTIGDVDSYQLPDAKGYSSLMRHLLGVTDEERQRKREEILTTSLKDFKEFAEAIDVVREKGVAVAVASAEDIDSANQARSNFFEVKKAL

SEQ ID NO: 7564 - protein, 347 aa, Brassica napus
KSMAGRADDLFNLMNCLLQEVQFTDQQRFKQFVSQSIARMENRLRGSGHGVAAARMDAMLNIAGWMSEQMGGLSYLEFLRTLEKKVDEDWEGISSSLEEIRRSLLAKNGCIVNMTADGKSLTNIEKSLEKFLDLLPENPSGGLVTWDGRLPLRNEAIVIPTQVNYVGKAGNIYSTGYELDGSAYVISKHISNTWLWDRVRVSGGAYGGFCDFDSHSGVFSFLSYRDPNLLKTLDIYDGTGDFLRGLDVDQETLTKAIIGTIGDVDSYQLPDAKGYSSLMRHLLGVTDEERLRKREEILTTSLKDFKDFAEAIDVVRDNGVAVAVASAEDIDAANNARSNFFEVKKAL

SEQ ID NO: 7565 - protein, 300 aa, Raphanus sativus
  misc_feature (125)..(125): Xaa can be any naturally occurring amino acid
  misc_feature (225)..(225): Xaa can be any naturally occurring amino acid
  misc_feature (275)..(275): Xaa can be any naturally occurring amino acid
GHGVAAARMDAMLNIAGWMSEQMGGLSYLEFLRTLEKKVDEDWEGISSSLEEIRRSLLAKNGCIVNMTADGKSLTSIEKSLEKFLDLLPENPSGGLVTWDGRLPLRNEAIVIPTQVNYVGKAGNXYSTGYELDGSAYVISKHISTTWLWDRVRVSGGAYGGFCDFDSHSGVFSFLSYRDPNLLKTLDIYDGTGDFLRGLDMDQETLTKAIIGTIGDVDSYQLPDXKGYSSLMRHLLGVTDEERQRKREEILTTSLKDFKDFAEAIDVVRDKGVSXAVASAEDIDAANNARSNFFEVKKAL

SEQ ID NO: 7566 - protein, 282 aa, Brassica rapa
TDQQRFKQFVSQSIARMENRLRGSGHGIAAARMDAMLNVAGLMSEQMGGLSYLEFLHTLAKKVDEDWEGISSSLEEIRRSLLARNGCLVNMTADGKSLTNIEKSVEKFLNLLPETPSGGLVTWDGRLPLRNEAIVIPTQVNYVGKAGNIYSTGYELDGSAYVISKHISNTWLWDRVRVSGGAYGGFCDFDSHSGVFSFLSYRDPNLLKTLDIYDGTGDFLRGLDVDQETLTKAIIGTIGDVDSYQLPDAKGYSSLMRHLLGVTDEERQRKRERDTNNKLKGL

SEQ ID NO: 7567 - protein, 738 aa, Arabidopsis lyrata
MFDASPARDTSKVEPQKLFSRPRRIVEKYPAGEDGDLKKKRMVCLNWLLSDKPLDLQTQLALGFLDHLMLGTPASPLRKILLGSGLGEALVNSGMEDELLQPQFSIGLKGVSDDNVQKVEELVMNTLRNLADEGFDTDAVEASMNSIEFSLRENNTGSFPRGLSLMLQSIAKWIYDMDPFEPLKYEEPLKSLKARIAEKGSKAVFSPLIEEFILNNPHCVTIEMQPDPEKASQEEAEEKIILEKVKASMTEEDLAELARATEELKLKQETPDPPEALKCVPSLNLSDIPKEPIYVPTEVGDINGVKVLRHDLFTNDILYTEVVFDMGSLKHELLQLIPLFCQSLLEMGTQDLTFVQLNQLIGRKTGGILVYPLTSSVYGRDDPCSKIIVRGKSMVGRAEDLFNLMNCVLQEVRFTDKQRFKQFVSQSRARMENRLRGSGQGIAAARMDAMLNVAGWMSEQMGGLSYLEFLHTLEQKVDQDWEGISSSLEEIRRSFLSRNCCIVNMTADGKSLTNTEKYVGKFLDLLPENPSGGLVTWDARLPLRNEGIVIPTQVNYVGKAGNIYSSGYELDGSSYVISKHISNTWLWDRVRVSGGAYGGFCDFDSHSGVFSFLSYRDPNLLKTLDIYDGTGDFLRGLDVDEDTLTKAIIGTIGDVDSYQLPDAKGYSSLLRHLLNVTDEERQIRREEILSTSLKDFKEFAEAIDSVRDKGVAVAVASQEDIDAANKERSNFFEVKKGL

SEQ ID NO: 7568 - protein, 667 aa, Cleome gynandra
TPASPLRKILLESGLGEALVRSGMQDELLQPQFSIGLKGVYEDNVQKVEELIMNSLQKLTEDGFDSDAVEASMNTIEFSLRENNTGSFPRGLSLMLQSIAKWIYDMDPFEPLKYEQPLKEFKARIAKEGSKAVFSPLIEEFILKNPHRVTIEMQPDPEKTSQEEAEEKKVLEKIKASMTQEDLAELARATEELRLKQETPDPPEALRRVPSLSLNDIPKQPIHVPTEVGDINGAKVLRHDLFTNDILYTEVVFDMGSLKQELLPLVPLFCQSLLEMGTKDMTFVQLNQLIGRKTGGISVYPLTSSVRGKDDPCSKIIVRGKSMAGRADDLFNLMNCVLQEVQFTDQQRFKQFVSQSKARMENRLRGSGHGIAATRMDAMLNASGWMSEQMGGLSYLEFLQTLEQKVDQDWEGISSSLEEIRKSFLSKNGCIVNMTADGKSLINTEKFVGKFLDLLPKNPSGGPVTWNSLLPFRNEAILIPTQVNYVGKAGNLYSAGYKLDGSAYVISKYISNTWLWDRVRVSGGAYGGFCDFDTHSGVFSFLSYRDPNLLKTLDIYDATGDFLRGLDIDEDTLTKAIIGTIGDVDSYQLPDAKGYSSLLRYLLGVTDEERQKRREEIITTSLKDFKEFAEAIDAIKDKGISVAVASPEDIDVANKERLGFFDVKKAL

SEQ ID NO: 7569 - protein, 144 aa, Brassica napus
MAEHHHRIRVYLASAILLLAVINTGIAAENPSEQKLTSRILQNEIVKEVNENPNAGWTAAFNDRFANSTVAEFKRLLGVKPTPKNEFLGVPVVSHDISLKLPKEFDARTAWSQCSSIGRILDQGHCGSCWAFGAVESLSDRFCI

SEQ ID NO: 7570 - protein, 112 aa, Brassica juncea
AADNLSKQKLTSRILQEEIVKEVSENPNAGWKAALNDRFANATVAEFKRLLGVKPTPKNEYLGVPVVTHDRSLKLPTEFDARTAWSQCTSIGRILDQGHCGSCWAFGAVESL

SEQ ID NO: 7571 - protein, 156 aa, Thellungiella halophila
MADSTTTTKLCLVSVFLLLGLVSSSFDLQGVKAENLSKQKLNSKILQEEIVKKVNQNPDAGWKAAINDRFSNATVAEFKRLLGVKPTPKKHFLGVPIVSHDRSLKLPKEFDARTAWPQCTSIGNILDQGHCGSCWAFGAVESLSDRFCIEFGMNIS

SEQ ID NO: 7572 - protein, 359 aa, Arabidopsis thaliana
MAVYNTKLCLASVFLLLGLLLAFDLKGIEAESLTKQKLDSKILQDEIVKKVNENPNAGWKAAINDRFSNATVAEFKRLLGVKPTPKKHFLGVPIVSHDPSLKLPKAFDARTAWPQCTSIGNILDQGHCGSCWAFGAVESLSDRFCIQFGMNISLSVNDLLACCGFRCGDGCDGGYPIAAWQYFSYSGVVTEECDPYFDNTGCSHPGCEPAYPTPKCSRKCVSDNKLWSESKHYSVSTYTVKSNPQDIMAEVYKNGPVEVSFTVYEDFAHYKSGVYKHITGSNIGGHAVKLIGWGTSSEGEDYWLMANQWNRGWGDDGYFMIRRGTNECGIEDEPVAGLPSSKNVFRVDTGSNDLPVASV

SEQ ID NO: 7573 - protein, 357 aa, Brassica oleracea
MAADPTTKLCVVSVVLLLALVSSLQGVSADNLTKQKLNSKILQEEIVKKVNEHPNAGWKAALNDRFSNATVAEFKRLLGVKPTPKKLLLGVPVVSHDQSLKLPKSFDARTAWPQCTSIGSILDQGHCGSCWAFGAVESLSDRFCIQFGMNITLSVNDLLACCGFRCGDGCDGGYPVAAWRYFSYSGVVTEECDPYFDQTGCSHPGCEPAYDTPKCMRKCVSGNQLWGESKHYSVSTYIVKSNPQDIMAEIYKNGPVEVSFTVYEDFAHYKSGVYKHITGYNIGGHAVKLIGWGTTDDGEDYWLLANQWNRSWGDDGYFMIRRGTNECGIEDEPVGGLPSSKNVFKVITGSDEISVAV

SEQ ID NO: 7574 - protein, 358 aa, Brassica rapa
MAADSTTKLCLVSVVLLLGLVSSLQGVSADNLTKQKLNSKILQEEIVKKVNEHPNAGWKAALNDRFSNATVAEFKRLLGVKPTPKKLLLGVPVVSHDQSLKLPKSFDARTAWPQCTSIGNILDQGHCGSCWAFGAVESLSDRFCIQFGMNITLSVNDLLACCGFRCGDGCDGGYPIAAWQYFSYSGVVTEECDPYFDQTGCSHPGCEPGYPTPKCMRKCVSGNQLWGESKHYSVSTYTVKSDPQDIMAEIYKNGPVEVSFTVYEDFAHYKSGVYKHITGSNIGGHAVKLIGWGTTDDGEDYWLLANQWNRSWGDDGYFMIRRGTNECGIEDEPVGGLPSSKNVFKVITGSDEISVASV

SEQ ID NO: 7575 - protein, 358 aa, Brassica napus
MAADPTTKLCLVSVVLLLALVSSLQGVAADNLTKQKLNSKILQEEIVKKVNEHPNAGWKAALNDRFSNATVAEFKRLLGVKPTPKKLLLGVPVVSHDQSLKLPKSFDARTAWPQCTSIGNILDQGHCGSCWAFGAVESLSDRFCIQFGMNITLSVNDLLACCGFRCGDGCDGGYPVAAWRYFSYSGVVTEECDPYFDQTGCSHPGCEPAYDTPKCMRKCVSGNQLWGESKHYSVSTYIVKSNPQDIMAEIYKNGPVEVSFTVYEDFAHYKSGVYKHITGYNIGGHAVKLIGWGTTDDGEDYWLLANQWNRSWGDDGYFMIRRGTNECGIEDEPVGGLPSSKNVFKVITGSDEISVASV

SEQ ID NO: 7576 - protein, 358 aa, Brassica napus
MAADPTTKLCLVSVVLLLGLVSSLQGVSADNLTKQKLNSKILQEEIVKKVNEHPNAGWKAAINDRFSNATVAEFKRLLGVKPTPKKLLLGVPVVSHDQSLKLPKSFDARTAWPQCTSIGNILDQGHCGSCWAFGAVESLSDRFCIQFGMNITLSVNDLLACCGFRCGDGCDGGYPIAAWQYFSYSGVVTEECDPYFDQTGCSHPGCEPGYPTPKCMRKCVSGNQLWGESKHYSVSTYTVKSDPQDIMAEIYKNGPVEVSFTVYEDFAHYKSGVYKHITGSNIGGHAVKLIGWGTTDDGEDYWLLANQWNRSWGDDGYFMIRRGTNECGIEDEPVGGLPSSKNVFKVITGSDEISVSSV

SEQ ID NO: 7577 - protein, 277 aa, Brassica napus
RIRLLVSGGAPLSTEIEEFLRVTCCCFVVQGYGLTETLGGTAMGFPDEMCMLGTVGIPAVYNEIRLEEVAEMGYDPLGENPAGEICIRGKCLFSGYYKNPKLTQEVMKDGWFHTGDIGEIQSNGVLKIIDRKKNLIKLSQGEYVALENLENIYGQNSLVQDIWVYGDSFKSMLVAVIVPNQETIKRWAKELGFTKPFEELCSLSELQEHIISELKSTAEKNKLRKFEYIKAVTVETKPFDVARDLVTATLKNRRNNLLKYYQVQVDEMYRKLASKKI

SEQ ID NO: 7578 - protein, 334 aa, Brassica napus
HEGIQKALQELNPRRRFIFNALYKHKLAWLNRGYSHSKASPMADFIAFRKIRDKLGGRIRLLVSGGAPLSTEIEEFLRVTCCCFVVQGYGLTETLGGTAMGFPDEMCMLGTVGIPAVYNEIRLEEVAEMGYDPLGENPAGEICIRGKCLFSGYYKNPKLTQEVMKDGWFHTGDIGEIQSNGVLKIIDRKKNLIKLSQGEYVALENLENIYGQNSLVQDIWVYGDSFKSMLVAVIVPNQETIKRWAKELGFTKPFEELCSLSELQEHIISELKSTAEKNKLRKFEYIKAVTVETKPFDVARDLVTATLKNRRNNLLKYYQVQVDEMYRKLASKKI

SEQ ID NO: 7579 - protein, 141 aa, Brassica napus
KLSQGEYVALENLENIYGQNSLGQDIWVYGDSFKTKLVAVIVPNQKTVKRWAKKLGFTKPFEELCSLSEFQEHIISELKSTAEKNKLRKFEYIKAVTVETKPFDVARDLVTATLKNRRNNLLKYYQVQVDEMYRKLASKKI

SEQ ID NO: 7580 - protein, 232 aa, Raphanus sativus
PDEMCMLGTVGIPAVYNEIRLEEVAEMGYDPLGENPAGEICIRGKCLFSGYYKNPELTQEVMKDGWFHTGDIGEIQSNGVLKIIDRKKNLIKLSQGEYVALENLENIYGQNSLVQDIWVYGDSFKSMLVAVIVPNQETVKRWAKELGFTKPFEELCSLSELQEHIISELKSTAEKNKLRKFEYIKAVTVETKPFDVARDLVTATLKNRRNNLLKYYQVHVEEMYRKLASEKI

SEQ ID NO: 7581 - protein, 151 aa, Thellungiella halophila
KIIDRKKNLIKLSQGEYVALENLENIYGQSSVVQDIWVYGDSFKSMLVAVIVPNPETVNRWAKDVGFTKPFEELCSLSELQEHIISELKSTAEKNKLRRFEYIKAVTVETKPFDVERDLVTATLKNRRNNLLKYYQVKIDEMYRKLASKKI

SEQ ID NO: 7582 - protein, 215 aa, Brassica juncea
EIRLEEVAEMGYDPLGENPAGEICIRGKCLFSGYYKNPELTDEVLKDGWFHTGDIGEIHANGVLKIIDRKKNLIKLSQGEYVALENLENIYGQNSVVQDIWVYGDSFKSMLVAVIVPNPEVVNRWAKDLGFNKPFEELCSLSELQEHIILELKSTAEKNKLKRFEYIKAVTVEIKPFDLERDLVTATLKNKRNNLLKYYQVQVDEMYRKLASKKI

SEQ ID NO: 7583 - protein, 184 aa, Brassica napus
SGYYKNPELTDEVLKDGWFHTGDIGEIQPNGVLKIIDRKKNLIKLSQGEYVALENLENIYGQNSLVQEIWVYGDSFKSMLVAVIVPNPEVVNRWAKDLGLNKPFEELCSLTELQEHIILELKSTAEKNKLKRFEYIKAVTVEIKPFDLERDLVTATLKNKRNNLLKYYQVQVDEMYRKLASKKI

SEQ ID NO: 7584 - protein, 332 aa, Brassica rapa
GIQKALQELHPRRRFIFNALYKHKLSWLNRGYSHSKASPMADLIAFRKIRDKLGGRIRLLISGGAPLSPEIEEFLRVTCCCFVLQGYGLTETLGGTALCVPDEMCMLGTVGIPAVYNEIRLEEVAEMGYDPLGENPAGEICIKGKCLFSGYYKNPELTDEVLKDGWFHTGDIGEIQPNGVLKIIDRKKNLIKLSQGEYVALENLENIYGQNSLVQEIWVYGDSFKSMLVAVIVPNPEVVNRWAKDLGLNKPFEELCSLTELQEHIILELKSTAEKNKLKRFEYIKAVTVEIKPFDLERDLVTATLKNKRNNLLKYYQVQVDEMYRKLASKKI

SEQ ID NO: 7585 - protein, 362 aa, Raphanus sativus
  misc_feature (354)..(354): Xaa can be any naturally occurring amino acid
  misc_feature (360)..(360): Xaa can be any naturally occurring amino acid
VLRDDIQELKPTYLAGVPRVFERIHEGIQKALQELNPRRRFILNALYKHKLSWLNRGYSHSKASPMADLIAFRKIRDKLGGRIRLLISGGAPLSPEIEEFLRVTCCCFVLQGYGLTETLGGTALCIPDEMCMLGTVGIPAVYNEIRLEEVAEMGYDPLGENPAGEICIRGKCLFSGYYKNPELTDEVLKDGWFHTGDIGEIQPNGVLKIIDRKKNLIKLSQGEYVALENLENIYGQNSVVQDIWVYGDSFKSMLVAVIVPNPEVVNRWAKDLGFNKPFEELCSLSELQEHIILELKSTAEKNKLKRFEYIKAVTVEIKPFDLERDLVTATLKNKRNNLLKYYQVQVDEMYRKLXSKNLKXLR

SEQ ID NO: 7586 - protein, 198 aa, Brassica oleracea
  misc_feature (5)..(5): Xaa can be any naturally occurring amino acid
SAAGXICIRGKCLFSGYYKNPKLTDEVLKDGWFHTGDIGEIQPNGVLKIIDRKKNLIKLSQGEYVALENLENIYGQNSVVQDIWVYGDSFKSMLVAVIVPNPEVVNRWAKDLGLNKPFEELCSLTELQEHIILELKSTAEKNKLKRFEYIKAVTVEIKSFDLERDLVTATLKNKRNNLLKYYQAQVDEMYRKLASKKI

SEQ ID NO: 7587 - protein, 251 aa, Brassica napus
  misc_feature (83)..(83): Xaa can be any naturally occurring amino acid
  misc_feature (104)..(104): Xaa can be any naturally occurring amino acid
VIKDEDMDRGAMHAGGDVDGRLDEATASLMLDTRPSKVISNELIVTVSCSLVKIDYEGRSDGRSIKSTIAHVSPLKLVLVHAXAEATEHLKQHCLNSICPHVYXPKIEETIDVTSDLCAYKVQLSEKLMSNVIFKKLGDSEVAWVDSEVGKTESEKRCLQPMASAAAPHKPVLVGDLKMQDFKQFLASKGVQVEFAGGGALRCGEYVTLRKVGPTGQKGGASGPQQILIEGPLCEDYYKIRDYLYSQFYLL

SEQ ID NO: 7588 - protein, 256 aa, Raphanus sativus
  misc_feature (163)..(163): Xaa can be any naturally occurring amino acid
NPDDYVIKDEDMDRGAMHAGGDVDGRLDEATASLMLDTRPSKVISNELIVTVSCSLVKMDYEGRSDGRSIKSTIAHVSPLKLVLVHATAEATEHLKQHSLNSICPHVYAPKIEETVDVTSDLCAYKVQLSEKLMSNVIFKKLGDSEVAWVDSEVGKTGSEMRXLQPMGSAAAPHKPVLVGDLKMQDFKQFLSSKGVQVEFAGGGALRCGEYVTLRKVGPTGQKGGASGPQQILIEGPLCEDYYKIRDYLYSQFYLL

SEQ ID NO: 7589 - protein, 148 aa, Thellungiella halophila
APQIEETVDVTSDLCAYKVQLSEKLMSNVIFKKLGDSEVAWVDSEVGKTESDMRSLLPMLSAATPHKPVLVGDLKIADFKQFLSSKGVQVEFAGGGALRCGEYVTLRKVGPTGQKGGASGPQQILIEGPLCEDYYKIRDYLYSQFYLL

SEQ ID NO: 7590 - protein, 99 aa, Cleome spinosa
RCCQYYPCRVLPPLPPHKSVLVGDLKIADFKQFLSSKGVQVEFAGGGALRCGEYVTLRKVGPTGQKGGASGPQQILIEGPLCEDYYRIRDYLYSQFYLL

SEQ ID NO: 7591 - protein, 365 aa, Brassica napus
EELIAYEEEQNRLKREEALRASLVKEDETKASHGPDDNSSEPMVIDTKTTHDVVGSHGPAYKDILIDGFVPPSSSIAPMFPFYDSTADWDEYGEVINPDDYVIKDEDMDRGAMHAGGDVDGRLDEATASLMLDTRPSKVISNELIVTVSCSLVKIDYEGRSDGRSIKSTIAHVSPLKLVLVHATAEATEHLKQHCLNSICPHVYAPKIEETIDVTSDLCAYKVQLSEKLMSNVIFKKLGDSEVAWVDSEVGKTESEKRCLQPMASAAAPHKPVLVGDLKMQDFKQFLASKGVQVEFAGGGALRCGEYVTLRKVGPTGQKGGASGPQQILIEGPLCEDYYKIRDYILSFTSSDGIREKIQLLLLLF

SEQ ID NO: 7592 - protein, 55 aa, Brassica rapa
EDREREAVSSNQWQVQQLLTNLVLVGDLKMQDFKQFLASKGVQVEFAGGGALRCR

SEQ ID NO: 7593 - protein, 59 aa, Cajanus cajan
EEARVERVQMGTSVQVTPLCGVYNENPLSYLVSIDTFNFLVDCGWNDHFDPSSFNPSLG

SEQ ID NO: 7594 - protein, 172 aa, Theobroma cacao
  misc_feature (111)..(111): Xaa can be any naturally occurring amino acid
VRGGSAASTEHLKQHCLKHVCPHVYAPQIEETIDVTSDLCAYKVQLSEKLMSNVLFKKLGDYEIAWVDAEVGKTENEMLSLLPLSTPAPPHKSVVVGDLKLADFKQFLASXGVKVEFAGGALRCGEYVTLRKVGFASQKGGGSGTQQIIIEGPLCEDYYKIRDYLYSQFYLL

SEQ ID NO: 7595 - protein, 739 aa, Citrus sinensis
MGTSVQVTPLSGVFNENPLSYLVSIDGFNFLIDCGWNDHFDPSLLQPLSKVASTIDAVLLSHPDTLHLGALPYAMKQLGLSAPVFSTEPVYRLGLLTMYDQYLSRRQVSEFDLFTLDDIDSAFQSVTRLTYSQNYHLSGKGEGIVVAPHVAGHLLGGTVWKITKDGEDVIYAVDYNRRKEKHLNGTVLESFVRPAVLITDAYNALHNQPPRQQREMFQDAISKTLRAGGNVLLPVDSAGRVLELLLILEDYWAEHSLNYPIYFLTYVSSSTIDYVKSFLEWMGDSITKSFETSRDNAFLLKHVTLLINKSELDNAPDGPKLVLASMASLEAGFSHDIFVEWASDVKNLVLFTERGQFGTLARMLQADPPPKAVKVTMSRRVPLVGEELIAYEEEQTRLKKEEALKASLVKEEESKASLGPDNNLSGDPMVIDANNANASADVVEPHGGRYRDILIDGFVPPSTSVAPMFPFYENNSEWDDFGEVINPDDYIIKDEDMDQAAMHIGGDDGKLDEGSASLILDAKPSKVVSNELTVQVKCLLIFIDYEGRADGRSIKTILSHVAPLKLVLVHGSAEATEHLKQHCLKHVCPHVYTPQIEETIDVTSDLCAYKVQLSEKLMSNVLFKKLGDYEIAWVDAEVGKTENGMLSLLPISTPAPPHKSVLVGDLKMADLKPFLSSKGIQVEFAGGALRCGEYVTIRKVGPAGQKGGGSGTQQIVIEGPLCEDYYKIRAYLYSQFYLL

SEQ ID NO: 7596 - protein, 193 aa, Vigna unguiculata
GRSDGRSIKNILSHVAPLKLVLVHGSAEATEHLKQHCLKHVCPHVYAPQIDETIDVTSDLCAYKVQLSEKLMSNVLFKKLGDYEVAWVDAVVGKTESDTLSLLPVSEAAPPHKSVLVGDLKLADIKQFLSGKGVQVEFAGGALRCGEYVTLRKVGDATQKGGGSGAQQIVIEGPLCEDYYKIRDYLYSQFYLL

SEQ ID NO: 7597 - protein, 557 aa, Arachis hypogaea
GGTVLGSFVRPAVLITDAYNALNNQPYRRQKDKEFGDILKKTLRAGGNVLLPIDTAGRVLELILILESYWADENLTYPIYFLTYVASSTIDYVKSFLEWMSDSIAKSFEQTRENIFLLKYITLLINKAELDNAPDGPKVVLASMASLETGFSHDIFVEWASDVKNLVLFTERGQYATLARMLQADPPPKAVKVTVSKRVPLVGDELIAYEEEQNRIKKEEALKASLMKEEELKASQGPDNNVSDPMVVDASNDHLSAEAAGPRGGGYRDILIDGFVPPSTSIAPMFPCYENTSEWDDFGEVINPDDYVIKDEDMDQGAMHAGGDINGKLDEGAASLILDTKPSKVISDERTVQVRCSLVYMDFEGRSDGRSIKNILSHVAPLKLVLVHGSAEATEHLKQHCLKHVCPHVYAPQIEETIDVTSDLCAYKVQLSEKLMSNVLFKKLGEYEIAWVDAEVEKTENEMLALVPVSSQVPPHKSVLVGDLKLADFKQFLSSKGVQVEFSGGALRCGEYVTLRKVGDTTQKGGSSGTQQIVIEGPLCEDYYKIREYLYSQFYLL

SEQ ID NO: 7598 - protein, 740 aa, Populus trichocarpa
MGTSVQVTPLSGVYNENPLSYLVSIDGFNFLIDCGWNDHFDPSLLQPLSKVASKIDAVLLSYGDMLHLGALPFAMKQFGLNAPVFSTEPVYRLGLLTMYDQSFSRKAVSEFDLFSLDDIDSAFQNFTRLTYSQNHHLSGKGEGIVIAPHVAGHLLGGTVWKITKDGEDVVYAVDFNHRKERHLNGTVLESFYRPAVLITDAYNALNSQPSRQQRDKQFLETILKTLEGGGNVLLPVDSAGRVLELLLILEQFWGQRFLNYPIFFLSYVSSSTIDYIKSFLEWMSDSIAKSFETSRDNAFLMKHVTLLISKDELDNASTGPKVVLASVASLEAGFSHDIFAEWAADVKNLVLFTERGQFGTLARMLQADPPPKAVKMTMSRRVPLVGDELIAYEEEQKRLKREEELKASLIKEEESKVSHGPDNNLSDPMVIDSGNTHSPLDVVGSRGSGHRDILIDGFVPPSTSVAPMFPFYENSLEWDEFGEVINPDDYVVQDEDMDQAAMHVGADIDGKLDEGSASLILDTKPSKVVSNELTVQVKCSLIYMDYEGRSDGRSIKSILTHVAPLKLVMVHGSAEATEHLKQHFLNIKNVQVYAPQIEETIDVTSDLCAYKVQLSEKLMSNVLFKKLGDYEVAWVDAEVGKTENGMLSLLPISSPAPPHKSVLVGDLKMADFKQFLASKGVQVEFAGGALRCGEYVTLRKVGNPSQKGGASGTQQIIIEGPLCEDYYKIREYLYSQFYLL

SEQ ID NO: 7599 - protein, 738 aa, Glycine max
MGTSVQVTPLCGVYNENPLSYLVSIDGFNFLVDCGWNDHFDPSLLQPLARVASTIDAVLLSHADTLHLGALPYAMKQLGLSAPVYSTEPVYRLGLLTMYDQYLSRKQVSEFDLFTLDDIDSSFQSVTRLTYSQNHHFSGKGEGIVIAPHVAGHLLGGTIWKITKDGEDVIYAVDFNHRKERHLNGTVLGSFVRPAVLITDAYNALNNQPYRRQNDKEFGDILKKTLREGGNVLLPVDTVGRVLELILMLESYWTDENLNYPIYFLTYVASSTIDYVKSFLEWMSDTIAKSFEKTRENIFLLKYVTLLINKTELDNAPDGPKVVLASMASLEAGFSHEIFVEWANDVKNLVLFTERGQFATLARMLQADPPPKAVKVVVSKRVALVGEELIAYEEEQNRIKKEALKASLMKEEEFKTSHGADNNTSDSMVIDSGNNHVPPEVSGPRGGGYRDIFIDGFVPPLTSVAPMFPCYENTSEWDDFGEVINPDDYVIKDEDMDQTAMHGGDINGKLDEGAASLILDTKPSKVVSDERTVQVRCSLVYMDFEGRSDGRSIKNILSHVAPLKLVLVHGSAEATEHLKQHCLKHVCPHVYAPQLEETIDVTSDLCAYKVLLSEKLMSNVLFKKLGDYELAWVDAVVGKTENDPLSLLPVSGAAPPHKSVLVGDLKLADIKQFLSSKGVQVEFAGGALRCGEYVTLRKVGDASQKGGGSGAQQIVIEGPLCEDYYKIRDYLYSQFYLL

SEQ ID NO: 7600 - protein, 257 aa, Glycine max
VINPDDYVIKDEDMDQTAMHGGSDINGKLDEGAASLILDTKPSKVVSDERTVQVRCSLVYMDFEGRSDGRSIKNILSHVAPLKLVLVHGSAEATEHLKQHCLKHVCPHVYAPQIEETIDVTSDLCAYKVQLSEKLMSNVLFKKLGDYEIAWVDAVVGKTENDPLSLLPVSGAAPPHKSVLVGDLKLADIKQFLSSKGVQVEFAGGALRCGEYVTLRKVGDASQKGGGSGAQQIVIEGPLCEDYYKIRDYLYSQFYLL

SEQ ID NO: 7601 - protein, 228 aa, Glycine max
MKTWTSDQTAMHGGSDIKGKLDEGAASLILDTKPSKVVSDERTVQVRCSLVYMNSEGRSDGRSIKNILSHVAPLKLVLVHGSAEATEHLKQHCLKHVCPHVYAPQIEETIDVTSDLCAYKVQLSEKLMSNVLFKKLGDYEIAWVDAVVGKTENDPLSLLPVSGAAPPHKSVLVGDLKLADIKQFLSSMGVQVEFAGGALRCGEYVTLRKVGDASQKARWWFWCSANSY

SEQ ID NO: 7602 - protein, 186 aa, Tropaeolum majus
HLDDIDSAFQNVTRLTYSQNYHLSGKGEGIVIAPHVAGHLLGGTVWKITKDGEDIIYAVDYNHRKERHLNGTALQTFVRPAVLITDAYNALNNQPPRQQRDKEFLDTISRTLEAGGNVLLPVDTAGRILELILILEQHWAQNFLNHPIFFLTYVSSSTIDYVKSFLEWMSDSIAKLLKLREIMLFF

SEQ ID NO: 7603 - protein, 735 aa, Quercus alba
VSPLCGVYNENPLSYLVSIDSFNFLIDCGWNDHFDPTLLQPLSKVASTIDAVLVSHPDTLHLGALPYAMKQLGLNAPVYATEPVYRLGLLTMYEQFLSRKQISEFDLFTLDDIDSAFQAMTRLTYSQNHHLTGKGEGIVIAPHVAGHLLGGTMWKITKDGEDVIYAVDLNHRKERHLNGTVLASFVRPAVLITDAYNALNNQPYRRGEKENEFGETIKKTLGAGGNVLLPVDTVGRVLELILTLEQYWTDKSLNYPIFFLTYVASSTIDYVKSFLEWMSDSIAKSFEQNRENPFLLKHVRFCISKSELDNAPDGPKVVLASMASLEVGFSHDIFVEWATDAKNLVLFTERGQFASLARILQADPPPKAVKVTMSKRVPLVGDELIAYEEEQNRIKKEEALKATLIKEEESKASQSADINASDPMVIDVSKTLASPDVAGQHSAGYRDILIDGFVPPSTSVAPMFPFYENTFDWDDFGEVINPDDYVIKDEDMDQTGMHVGGNLDGKFDEGSANLILDTKPSKVVSNELTVHVKCSLIYMDFEGRSDGRSIKSILSQVAPLKLVLVHGSAEATEHLKQHCLKHVCPHVYAPHIEETIDVTSDLCAYKVQLSEKLMSNVLFKKLGDYEIAWVDAEVGKTDSGMLSLLPCSNAAPLHKSVLVGDLKMADFKQFLASKGVQVEFAGGALRCGEYVTIRKVGDASQKGGGSGLQQILIEGPLCEDYYKIRDYLYSQFFLL

SEQ ID NO: 7604 - protein, 173 aa, Manihot esculenta
VLVHGSAESTEHLKQHCLKHVCPQVFAPQIEETIDVTSDLCAYKVQLSEKLMSNVLFKKLGDYEIAWVDAEVGRTESGTLSLLPITTAAPPHKSVLVGDLKMADFKQFLASKGVQVEFAGGALRCGEYVTLRKVGNVSQKGGGSGTQQIVIEGPLCEDYYKIREYLYSQFYLL

SEQ ID NO: 7605 - protein, 116 aa, Manihot esculenta
KKLGDYEHAKVDADLGRTESGTKSLKPITTAAPPHKSVLVGDLKMADFKQFLASKGVQVEFAGGALRCGEYVTLRKVGNVSQKGGGSGTQQIVIEGPLCEDYYKIREYLYSQFYLL

SEQ ID NO: 7606 - protein, 740 aa, Ricinus communis
MGTSVQVTPLNGVYNENPLSYLISIDNFNLLIDCGWNDHFDPSLLQPLSRVASTIDAVLLSHSDTLHLGALPYAMKQLGLSAPVYSTEPVYRLGLLTMYDQYLSRKAVSEFDLFSLDDIDSAFQNITRLTYSQNHHLSGKGEGIVIAPHVAGHLLGGTVWKITKDGEDVVYAVDFNHRKERHLNGTVLESFVRPAVLITDAYNALSNQPPRQQRDKEFLEKTILKTLEAGGNVLLPVDTAGRVLELLLILEQFWAHRLLNYPIFFLTYVSSSTIDYVKSFLEWMSDSIAKSFETSRDNAFLLKHVTLLINKNELDNAPNVPKVVLASMASLEAGFSHDIFVEWAADVKNLVLFTERGQFGTLARMLQADPPPKAVKVTMSRRVPLVGDELIAYEEEQKRLKKEEELNASMIKEEEAKVSHGPDSNLSDPMIIDASNNNASLDAVGSQGTGYRDILFDGFVPPSTSVAPMFPFYENTTEWDDFGEVINPDDYVIKDDDMDQPMHVGGDIDGKFDEGSASWILDTKPSKVVSSELTVQVKCSLIYMDYEGRSDGRSIKSILAHVAPLKLVLVHGSAESTEHLKQHCLKHVCPHVYAPQIEETIDVTSDLCAYKVQLSEKLMSNVLFKKLGDFEIAWVDAEVGKTESDALSLLPISTSAPPHKSVLVGDLKMADFKQFLASKGVQVEFAGGALRCGEYVTLRKVGNINQKGGGSGTQQIVIEGPLCEDYYKIREYLYSQFYLL

SEQ ID NO: 7607 - protein, 742 aa, Gossypium hirsutum
MGTSVQVTPLCGVYNENPLSYLVSIDGFNFLIDCGWNDLFDPSLLQPLSRVASTVDAVLLSHSDTLHLGALPYAMKQFGLSAPFYSTEPVHRLGLLTMYDHYLSRKQVSDFDLFSLDDIDAAFQSITRLTYSQNYHLSGKGEGIVIAPHVAGHLLGGTVWKITKDGEDVIYAVDFNRRKEKHLNGTVLESFVRPAVLITDAYNALNNQPPKPQRERDRDFVEIISKTLEGGGNVLLPVDTAGRVLELLLVLEENWSLKSLNFPIYFVTYVSASTIDYVKSFLEWMSDAIAKSFETSRDNAFLLKNIKLLTSKSELDSVPDGPKVILASMASLEAGFSHDIFVEWAADVKNLVLFTERGQFGTLARMLQADPPPKAVKVTMSRRVPLTGEELIAYEEEQNRLKKEEALKASLIKEEESKASLATDVNSSDPMVIDTHNKHPSLDGLGQHGSRFRDVLIDGFVPPSSSVAPMFPFYDNTSDWDDFGEVINPDDYVIKDEDMDQGATRTGGDMDGKLDEGSASLILDTTPSKVISNELTVQVKSSLVYMDYEGRSDGRSVKSILAHVAPLKLVLVHGSAEATEHLKQHCLKHVCPHVYAPQIEETIDVTSDLCAYKVQLSEKLMSNVLFKKLGDYEIAWVDAEVGKTENDMLSLLPISTPAPPHKSVVVGDLKMADFKQFLASKGVKVEFAAGALRCGEYVTLRKVGVASQKGGGSGTQQIIIEGPLCEDYYKIREYLYSQFYLL

SEQ ID NO: 7608 - protein, 742 aa, Gossypium hirsutum
MGTSVQVTPLCGVYNENPLSYLVSIDGFNFLIDCGWNDLFDPSLLQPLSRVASTVDAVLLSHSDTLHLGALPYAMKQFGLSAPFYSTEPVHRLGLLTMYDHYLSRKQVSDFDLFSLDDIDAAFQSITRLTYSQNYHLSGKGEGIVIAPHVAGHLLGGTVWKITKDGEDVIYAVDFNRRKEKHLNGTVLESFVRPAVLITDAYNALNNQPPKPQRERDRDFVEIISKTLEGGGNVLLPVDTAGRVLELLLVLEENWSLKSLNFPIYFVTYVSASTLDYVKSFLEWMSDAIAKSFETSRDNAFLLKNIKLLTSKSELDSVPDGPKVILASMASLEAGFSHDIFVEWAADVKNLVLFTERGQFGTLARMLQADPPPKAVKVTMSRRVPLTGEELIAYEEEQNRLKKEEALKASLIKEEESKASLATDVNSSDPMVIDTHNKHPSLDGLGQHGSRFRDVLIDGFVPPSSSVAPMFPFYDNTSDWDDFGEVINPDDYVIKDEDMDQGATRTGGDMDGKLDEGSASLILDTTPSKVISNELTVQVKSSLVYMDYEGRSDGRSVKSILAHVAPLKLVLVHGSAEATEHLKQHCLKHVCPHVYAPQIEETIDVTSDLCAYKVQLSEKLMSNVLFKKLGDYEIAWVDAEVGKTENDMLSLLPISTPAPPHKSVVVGDLKMADFKQFLASKGVKVEFAAGALRCGEYVTLRKVGVASQKGGGSGTQQIIIEGPLCEDYYKIREYLYSQFYLL

SEQ ID NO: 7609 - protein, 83 aa, Quercus alba
CHKSVLVGDLKMADFKQFLASKGVQVEFAGGALRCGEYVTIRKVGDASQKGGGSGLQQILIEGPLCEDYYKIRDYLYSQFFLL

SEQ ID NO: 7610 - protein, 740 aa, Populus trichocarpa
MGTSVQVTPLSGVYNENPLSYLVSIDGFNFLIDCGWNDHFDPSLLQPLSKVASKIDAVLLSYGDMLHLGALPFAMKQFGLNAPVFSTEPVYRLGLLTMYDQSFSRKAVSEFDLFSLDDIDSAFQNFTRLTYSQNHHLSGKGEGIVIAPHVAGHLLGGTVWKITKDGEDVVYAVDFNHRKERHLNGTVLESFYRPAVLITDAYNALNSQPSRQQRDKQFLETILKTLEGGGNVLLPVDSAGRVLELLLILEQFWGQRFLNYPIFFLSYVSSSTIDYIKSFLEWMSDSIAKSFETSRDNAFLMKHVTLLISKDELDNASTGPKVVLASVASLEAGFSHDIFAEWAADVKNLVLFTERGQFGTLARMLQADPPPKAVKMTMSRRVPLVGDELIAYEEEQKRLKREEELKASLIKEEESKVSHGPDNNLSDPMVIDSGNTHSPLDVVGSRGSGHRDILIDGFVPPSTSVAPMFPFYENSLEWDEFGEVINPDDYVVQDEDMDQAAMHVGADIDGKLDEGSASLILDTKPSKVVSNELTVQVKCSLIYMDYEGRSDGRSIKSILTHVAPLKLVMVHGSAEATEHLKQHFLNIKNVQVYAPQIEETIDVTSDLCAYKVQLSEKLMSNVLFKKLGDYEVAWVDAEVGKTENGMLSLLPISSPAPPHKSVLVGDLKMADFKQFLASKGVQVEFAGGALRCGEYVTLRKVGNPSQKGGTSGTQQIIIEGPLCEDYYKIREYLYSQFYLL

SEQ ID NO: 7611 - protein, 423 aa, Malus domestica
ESHEGQKDKEFTDAIKKTLRSDGNVLLPVDTAGRVMELVQILESCWTEENLNYPIFFLTYVASSTIDYVKSFLEWMSDAIAKSFEKTRENVFNLKRIRLLVSKSELDDAPDGPKVVLASMASLEAGFSHDIFVEWANDPKNLVLFTERAQFGSLARMLQADPPPKAVKVTISKRVPLVGEELIAYEEEQNRIRKEEALKASLVKEEESKASHGADVNTSDPMIIDASNTHSLPDAAGPQGSGYRDILIDGFTPPSTSVAPMFPFYENSTEWDDFGEVINPDDYVIKDEDMDHGAMHVGGDMDGKLDEGSASLILDTRPSKVVSTELTVQVKCSLIYMDFEGRSDARSIKSILSHMAPLKLVLVHGTAEATEHLKQHCLKHVCPHVYAPHIEETIDVTSDLCAYKVQLSEKLVTCSLKRLEITK

SEQ ID NO: 7612 - protein, 122 aa, Medicago truncatula
MSSVLFKKLGEYEVAWVDAEAGKTENDMLSLLPVSGAPHPHKSVLVGDLKLADFKQFLSTKGVPVEFAGGALRCGEYVTVRKVGDATQKGAGSGTQQIIIEGPLCEDYYKIRDYLYSQFYLL

SEQ ID NO: 7613 - protein, 63 aa, Pisum sativum
TTGIPVEFAGGALRCGEYVTVRKVGDATQKGAGSGTQQIIIEGPLCEDYYKIRDYLYSQFYLL

SEQ ID NO: 7614 - protein, 740 aa, Prunus persica
MGTSVQVTPLCGVYNENPLSYLVSIDGFNFLIDCGWNDHFDPSLLEPLSRVASTVDAVLLSHPDTLHLGALPFAMKQLGLSAVVYSTEPVYRLGLLTMYDQYLSRKQVSDFDLFTLDDIDSAFQNVTRLTYAQNHHLSGKGEGIVISPHVSGHLLGGTVWKITKDGEDVIYAVDFNHRKEKHLNGINQASFVRPAVLITDAYNALNNQPYRRQKDKEFTDTIKKTLRSDGNVLLPVDTAGRVLELVQILESCWADENLNYPIFFLTYVASSTIDYVKSFLEWMSDSIAKSFEKTRENAFILKRITLLVNKSELDNAPDGPKVVLASMASLEAGFSHDIFVEWATDPKNLVLFTERAQFGTLARMLQADPPPKAVKVTMSRRVPLVGEELIAYEEEQNRIRKDEALKASLIKEEESKSAQGADVSTSDPTVVDASNTHSLLDAAGPHGGGYRDMLIDGFTPPSTSAAPMFPFYENNSDWDDFGEVINPDDYVIKDADMDQGAMHVGGDMDGKLDEGSASLILDTRPSKVVATELTVQVKCSLIYMDFEGRSDARSIKSILSHMAPLKLVLVHGTAEATEHLKQHCLTHVCPHVYAPQIEETIDVTSDLCAYKVQLSEKLMSNVLFKKLGDYEIAWVDSEAGKTENGALSLLPISTPAPPHESVLVGDLKMANFKQFLSDNGVQVEFAGGALRCGEYVTLRKVGDASHKGGGSGTQQIVIEGPLCEDYYKIREYLYSQFYLL

SEQ ID NO: 7615 - protein, 231 aa, Prunus persica
KDEALKASLIKEEESKSAQGADVSTSDPTVVDASNTHSLLDAAGPHGGGYRDMLIDGFTPPSTSAAPMFPFYENNSDWDDFGEVINPDDYVIKDADMDQGAMHVGGDMDGKLDEGSASLILDTRPSKVVATELTVQVKCSLIYMDFEGRSDARSIKSILSHMAPLKLVLVHGTAEATEHLKQHCLTHVCPHVYAPQIEETIDVTSDLCAYKVQLSEKLMSTCSLRSLEITK

SEQ ID NO: 7616 - protein, 384 aa, Arachis hypogaea
MLQADPPPKAVKVTVSKRVPLVGDELIAYEEEQNRIKKEEALKASLMKEEELKASQGPDNNVSDPMVVDASNDHLSAEAAGPRGGGYRDILIDGFVPPSTSIAPMFPCYENTSEWDDFGEVINPDDYVIKDEDMDQGAMHAGGDINGKLDEGAASLILDTKPSKVISDERTVQVRCSLVYMDFEGRSDGRSIKNILSHVAPLKLVLVHGSAEATEHLKQHCLKHVCPHVYAPQIEETIDVTSDLCAYKVQLSEKLMSNVLFKKLGEYEIAWVDAEVEKTENEMLALVPVSSQVPPHKSVLVGDLKLADFKQFLSSKGVQVEFSGGALRCGEYVTLRKGWRYNSERVEVLVLTKLLLKVLCARIIIKFVNIFIHNFIGFRFGWTP

SEQ ID NO: 7617 - protein, 286 aa, Raphanus sativus
DINPRATGKQILRVSRSAVLGFGCFMGILAVILNKAGVSLGWMYLAMGVLIGSAVIPIAFMLLWSKANAFGAILGSISGCVLGIVTWLSTAKIQYGRVDLDTTGRNAPMLAGNLVAILTGGLIHAVCSLVQPQNYDWSTTKEIKVVEAEAPGNDIDVPVEELKEEKLRRAKAWIVKWGLVFTLLIVVIWPVLSLPARVFSRGYFWFWAIVAVAWGTIGSIVIIGLPLIESWETIKSVCMGMFTNDRLMNKLDDLNHRLQALTKAVPEAERIYLLEIEKTKKTDEES

SEQ ID NO: 7618 - protein, 306 aa, Brassica rapa
SSELIAVSSLFTYDIYRTYINPKATGKQILRVSRSGVLGFGCLMGILAVILNKVGVSLAWMYLAMGVLIGSAVIPIAFMLLWRKANAIGAILGSISGCVLGIVTWLSTAKIQYGRVDLDTTGRNAPMLAGNLVAILTGGLIHAVCSLVQPQNYDWSTTREIKLVEDGASGDVNDVPLEELREEKLKRAKAWIVRWGLVFTLVIVVIWPVLSLPARVFSRGYFWFWAIVAIAWGTIGSIVIVGLPLIESWGTIKSVCMGLFTNDRLMDKLDDLNHRLRALTMAVPEAERIYLLELEKTKKTDEERSI

SEQ ID NO: 7619 - protein, 239 aa, Brassica oleracea
LIGSAVIPIAFMLLWRKANAIGAILGSISGCVLGIVTWLSTAKIQYGRVDLDTTARNAPMLAGNLVAILTGGLIHAVCSLVQPQNYDWSTTREIKLVEDGASGDVNDVPLEELREEKLKRAKAWIVRWGLVFTLVIVVIWPVLSLPARVFSRGYFWFWAVVAIAWGTIGSIVIVGLPLIESWGTIKSVCMGLFTNDRLMDKLDDLNHRLRALTMAVPEAERIYLLELEKTKKTDEERSI

SEQ ID NO: 7620 - protein, 246 aa, Brassica napus
NYRGSYVTMLSSGGAVFGLINIVGNFGTVFVDNGYWVSAIAARPSATHKGYLLGGLVWFAVPFSLATSLGLGALALDLPITKDEADRGLVPLATAIALMGKTGSMLLLTMLFMAVTSAGSSELIAVSSLFTYDIYRTYINPKATGKQILRVSRSGVLGFGCLMGILAVILNKVGFHSHGCISQWEFSSALPLFPSRSCFCGEKLMQLVRFLGRSLAVFLGSLLGYQPQRYNTDALILIPQREMLRC

SEQ ID NO: 7621 - protein, 265 aa, Brassica napus
MSHGDPCSDLEQSGVSLAWMYLAMGVLIGSAVIPIAFMLLWRKANAIGAILGSISGCVLGIVTWLSTAKIQYGRVDLDTTARNAPMLAGNLVAILTGGLIHAVCSLVQPQNYDWSTTREIKLVEDGASGDVNDVPLEELREEKLKRAKAWIVRWGLVFTLVIVVIWPVLSLPARVFSRGYFWFWAVVAIAWGTIGSIVIVGLPLIESWGTIKSVCMGLFTNDRLMDKLDDLNHRLRALTMAVPEAERIYLLELEKTKKTDEERSI

SEQ ID NO: 7622 - protein, 218 aa, Brassica napus
AFGAILGSISGCVLGIVTWLSTAKIQYGRVDLDTTGRNAPMLAGNLVAILTGGFIHAVCSLVQPQNYDWSTTREIKVVEAEAPGDDIDVPVEELKEEKLRRAKAWIVKWGLVFTLLIVVIWPVLSLPARVFSRGYFWFWAIVAVAWGTIGSIVIIGLPLIESWETIKSVCMGMFTNDRLMNKLDDLNHRLQALTKAVPEAERIYLLEIEKTKKTDEES

SEQ ID NO: 7623 - protein, 218 aa, Brassica napus
  misc_feature (54)..(54): Xaa can be any naturally occurring amino acid
AFGAILGSISGCVLGIVTWLSTAKIQYGRVDLDTTGRNAPMLAGNLVAILTGGXIHAVCSLVQPQNYDWSTTREIKVVEAEAPGDDIDVPVEELKEEKLRRAKAWIVKWGLVFTLLIVVIWPVLSLPARVFSRGYFWFWAIVAVAWGTIGSIVIIGLPLIESWETIKSVCMGMFTNDRLMNKLDDLNHRLQALTKAVPEAERIYLLEIEKTKKTDEES

SEQ ID NO: 7624 - protein, 185 aa, Brassica juncea
HQAAPRKVAPIENKLPCSLEDLYKGTTKKMKISREILDVSGKATQTEEILTIGVKPGWKKGTKITFPEKGNEHPGVIPADLVFIIDEKPHPVFTRDGNDLIVTQKISLAEALTGYTVNLTTLDGRTLTIPVTNVIHPEYEEVVPKEGMPLQKDQTKKGNLRIKFSIKFPARLTAEQKSGFKKLLG

SEQ ID NO: 7625 - protein, 143 aa, Brassica juncea
ATQTEEILTIGVKPGWKKGTKITFPEKGNEHPGVIPADLVFIIDEKPHPVFTRDGNDLIVTQKISLAEALTGYTVNLTTLDGRTLTIPVTNVIHPEYEEVVPKEGMPLQKDQTKKGNLRIKFSIKFPARLTSEQKSGFKKLLG

SEQ ID NO: 7626 - protein, 150 aa, Brassica juncea
ILDASGKATQTEEILTIGVKPGWKKGTKITFPEKGNEHPGVIPADLVFIIDEKPHPVFTRDGNDLIVTQKISLAEALTGYTVNLTTLDGRTLTIPVTNVIHPEYEEVVPKEGMPLQKDQTKKGNLRIKFSIKFPARLTSEQKSGFKKLLG

SEQ ID NO: 7627 - protein, 317 aa, Brassica napus
MGVDYYKLLQVDRSATDDDLKKAYRKLAMKWHPDKNPTNKKDAEAKFKQISEAYDVLSDPQKRAVYDQYGEEGLKGNVPPPNAASGASYFSTGFNPRSADDIFAEFFGFSTPFGGGGGAGGSMHHHHHHHHHHQAAARKVAPIENKLPCSLEDLYKGTTKKMKISREILDASGKATQTEEILTIGVKPGWKKGTKITFPEKGNEHPGVIPADLVFIIDEKPHPVFTRDGNDLIVTQKISLAEALTGYTVNLTTLDGRTLTIPITNVIHPEYEEVVPKEGMPLQKDQTKKGNLRIKFNIKFPARLTTEQKSGFKKLLG

SEQ ID NO: 7628 - protein, 188 aa, Brassica napus
HHHHQAAARKVAPIENKLPCSLEDLYKGTTKKMKISREILDASGKATQTEEILTIGVKPGWKKGTKITFPEKGNEHPGVIPADLVFIIDEKPHPVFTRDGNDLIVTQKISLAEALTGYTVNLTTLDGRTLTIPVTNVIHPEYEEVVPKEGMPLQKDQTKKGNLRIKFSIKFPARLTSEQKSGFKKLLG

SEQ ID NO: 7629 - protein, 195 aa, Raphanus sativus
  misc_feature (38)..(38): Xaa can be any naturally occurring amino acid
  misc_feature (95)..(95): Xaa can be any naturally occurring amino acid
  misc_feature (110)..(110): Xaa can be any naturally occurring amino acid
GEGGGGGGAMHHSVPKKAAPIENKLPCSLEDLYKGTTXKMKISREIADVSGKTMPVEEILTIDVKPGWKKGTRITFPEKGNEQPGVTPADLVFIXDEKPHPVFTREGNDXVVTQKVSLVEALTGCTVNLITLDGRRLTIPVTSVIHPEYEEVIPKEGMPLQKDQTKRGNLRIKFNIKFPTRLTLEQKTGVKKLFG

SEQ ID NO: 7630 - protein, 146 aa, Raphanus sativus
KLPCSLEDLYKGTTKKMKISREILDVSGKATQTEEILTIGVKPGWKKGTKITFPEKGNEHPGVIPADLVFIIDEKPHPVFTRDGNDLIVTQKISLAEALTGYTVNLTTLDGRTLTIPVTNVIHPEYEEVGLKRGCHFRKIRQRKGT

SEQ ID NO: 7631 - protein, 321 aa, Brassica napus
MGVDYYKLLQVDRSATDDDLKKAYRKLAMKWHPDKNPTNKKDAEAKFKQISEAYDVLSDPQKRAVYDQYGEEGLKGNVPPPNAASGASYFSTGFNPRSADDIFAEFFGFSTPFGGGGGGGAGGSMHHHHHHHPHHHHQAAARKVAPIENKLPCSLEDLYKGTTKKMKISREILDASGKATQTEEILTIGVKPGWKKGTKITFPEKGNEHPGVIPADLVFIIDEKPHPVFTRDGNDLIVTQKISLAEALTGYTVNLTTLDGRTLTIPITNVIHPEYEEVVPKEGMPLQKDQTKKGNLRIKFSIKFPARLTSEQKSGFKKLLG

SEQ ID NO: 7632 - protein, 216 aa, Brassica napus
GAGQRFASRIFGDDMYGSSFGEGGHPPHHHHHHGAARKVAPIENKLPCSLEDLYKGTTKKMKISREIADVSGRTTQTEEILTIGVKPGWKKGTKITFPEKGNEHPGVIPADLVFIIDEKPHPVFTRDGNDLIVTQKISLSEALTGYTVNITTLDGRTLTIPITNVIHPEYEEVVPKEGMPLQKDQTKKGNLRIKFNIKFPARLTAEQKAGFKKLLG

SEQ ID NO: 7633 - protein, 177 aa, Brassica rapa
  misc_feature (148)..(148): Xaa can be any naturally occurring amino acid
MGVDYYKVLQVDRSASDDDLKKAYRKLAMKWHPDKNPTNKKEAEAKFKQISEAYDVLSDPQKRAVFDQYGEEGLKGNVPPPNAAGGSSYFSAGDGPSSFRFNPRSADDIFAEFFGFSTPFGGGGAGGSPFGGGGGAGGSGIGQRFASXIFGDDMYGTRSVKEDTLIIITVQLGKWLQ

SEQ ID NO: 7634 - protein, 284 aa, Arabidopsis thaliana
MSHPRNADDIFSEFFGVSRPSGPSGPRNADDIYSEFFGVSSPSGPRNKDDIFSEFFEVSNPSGPRDKDDISAEYFGVPSPSGSGSSGGREGGGGGGGTMHHGGARKAAPVEKKLPCSLEDLYKGTTKKMKISREIAGVFGKTTQVQEILTVDVKPGWKTGTKITFSEKGNEQPGVIPADLVFIIDEKPHPVFTREGNDLVVTQKISVLEAFTGYTVNLTTLDGRRLTIPVNTVIHPEYVEVVPNEGMPLQKDQAKKGNLRIKFNIKFPTTLTSEQKTGLKKLLG

SEQ ID NO: 7635 - protein, 317 aa, Arabidopsis thaliana
LYSRYSSSLVIIIVLLPQSERFLEHSFHTLRRNMSHPRNADDIFSEFFGVSRPSGPSGPRNADDIYSEFFGVSSPSGPRNKDDIFSEFFEVSNPSGPRDKDDISAEYFGVPSPSGSGSSGGREGGGGGGGTMHHGGARKAAPVEKKLPCSLEDLYKGTTKKMKISREIAGVFGKTTQVQEILTVDVKPGWKTGTKITFSEKGNEQPGVIPADLVFIIDEKPHPVFTREGNDLVVTQKISVLEAFTGYTVNLTTLDGRRLTIPVNTVIHPEYVEVVPNEGMPLQKDQAKKGNLRIKFNIKFPTTLTSEQKTGLKKLLG

SEQ ID NO: 7636 - protein, 174 aa, Castanea mollissima
MGVDYYKILQVDRSAKDDDLKKAYRKLAMKWHPDKNPNNKKEAEAKFKQISEAYEVLSDPQKRAVYDQYGEEGLKGQVPPPDAGGPGGPGGASFFSTGNGPTTFRFNPRSADDIFAEFFGFSAPFGGMGGMGGGGGGGGGMRGPRFSSGIFGDDGFASFGEGGGGGRVYAPRCS

SEQ ID NO: 7637 - protein, 197 aa, Quercus alba
GFMHQGAPRKAPPIESRLPCSLEELYKGATKKMKISREIADISGKTIQVEEILTIDIKPGWKKGTKITFPEKGNEQPNVTPADLVFIIDEKPHSVFTRDGNDLIVTQKISLADALTGYTVHLTTLDGRTLNIPINNVINPNYEEVVPREGMPIQKDPTKKATYVSNSTSSSLQGLLQSRRLESRNFWVHEHVILGEM

SEQ ID NO: 7638 - protein, 126 aa, Raphanus sativus
  misc_feature (22)..(22): Xaa can be any naturally occurring amino acid
  misc_feature (125)..(125): Xaa can be any naturally occurring amino acid
KGTKITFPEKGNEHPGVIPADXVFIIDEKPHPVFTRDGNDLIVTQKISLAEALTGYTVNITTLDGRTLTIPITNVIHPEYEEVVPREGMPLQKDQTEKGNLRIKFNIKFPARLTAEQKAGFKKLXG

SEQ ID NO: 7639 - protein, 263 aa, Arabidopsis lyrata
MSHPRKADDIFSEFFGSPSGPRTADDISAEFFGVSSPSGPRTADDIFSEFFEFPRPSAAAAGGNGGGGKGGGGGGGSSYPGGARKAAPVEKKLPCSLEDLYKGTTKKMKISREIAGVFGKTMQVEEILTVDVKPGWKKGTKITFTAKGNEQPGVISADLVFIIDEKPHPIFTRDGNDLLVTQNISVLEAFTGYTVILTTLDGRRLTIPVNTVIHPEYVEVVPNEGMPLQKDQTKKGNLTIKFNIKFPTRLTSEQKTGLKKILG

SEQ ID NO: 7640 - protein, 340 aa, Heritiera littoralis
MGVDYYKIMQVDKNAKDEDLKKAYRKLAMKWHPDKNPNNKKEAEAKFKQISEAYEVLSDPQKRAIYDQYGEEGLKGQVPPPDAGGATFFQTGDGPNVFRFNPRNANDIFAEFFGFSSPFGSMGGGGGSGMRGGSRTFGGMFGDDIFSSFGEGRPMSQGPRKAPPIENTLPCSLEELYKGTTKKMKISREIADASGKTLPVEEILTIDIKPGWKKGTKITFPEKGNEQPNVIPADLVFIIDEKPHSTFTREGNDLIVTQKISLAEALTGYTVHLTTLDGRSLTIAITNLIHPSYEEVVPREGMPIPKEPSKRGNLRIKFNIKFPTRLTAEQKSGIKKLLAP

SEQ ID NO: 7641 - protein, 339 aa, Cucumis melo
MGIDYYKVLQVDRNAKDDDLKKAYRKLAMKWHPDKNPNNKKEAEAKFKQISEAYEVLSDPQKKEIYDQYGEEGLKGQVPPPDAGGPGGGASFFSTGDRSSTFRFNPRNAEDIYAEFFGSSNPFGGMGGGPRFSSSIFGDDIFTSFRESGGGSMNQASSRKAAPIENRLPCSLEDLYKGTTKKMKISREVSDTTGKIVTVEEILTIDIKPGWKKGTKITFPEKGNEQPNVIPADLVFIIDEKPHSVFTRDGNDLIVTQKISLAEALTGYTVHLTTLDGRSLTIPINNVVNPSYEEVVPREGMPMQKDPTKKGSLRIKFNIKFPSRLTTEQKAGIKKLLGQ

SEQ ID NO: 7642 - protein, 354 aa, Quercus alba
MGVDYYKILQVDRSAKDDDLKKAYRKLAMKWHPDKNPNNKKEAEAKFKQISEAYEVLSDPQKRAVYDQYGEEGLKGQVPPPDAGGPGGPGGASFFSTGNGPTTFRFNPRNADDIFAEFFGFSGPFGGMGGMGGGGGGGGMRGSRFSSGFFGDDGFASFGEGGGGGGFMHQGAPRKAPPIESRLPCSLEELYKGASKKMKISREIADISGKTIQVEEILTIDIKPGWKKGTKITFPEKGNEQPNVIPADLVFIVDEKPHSVFTRDGNDLIVTQKISLADALTGYTVHLTTLDGRTLNIPINNVINPNYEEVVPREGMPIQKDPTKKGNLRIKFNIKFPTRLTSEQKAGIKKLLGP

SEQ ID NO: 7643 - protein, 162 aa, Cajanus cajan
GTTKKMKISREIADASGQTMPVEEILTINVKPGWKKGTKITFPEKGNEQPNVTPADLVFIIDEKPHGVFTRDGNDLVATQKISLAEALTGYTVHLTTLDGRNLTIPINNVIHPNYEEVVPREGMPLPKDPSKKGNLRIKFNIKFPTRLTDEQKSGIRKLLAP

SEQ ID NO: 7644 - protein, 58 aa, Cajanus cajan
KLPCTLEEIYKGTTKKMKISREIADASGQTMPVEEIFNHLMSSQVEKGTKITFPEKGQ

SEQ ID NO: 7645 - protein, 209 aa, Phaseolus coccineus
SRFPGGMFGDDMFASFGDGGVHMSQGAPRKAPPIENKLPCTLEEIYRGTTKKMKISREIADASGKTMQVEEILTINVKPGWKKGTKITFPEKGNEQPNVTPADLVFIIDEKPHGVFTRDGNDLVVTQKISLAEALTGYTVHVTTLDGRNLTIPISNVIHPSYEEVVPREGMPLPKDPSKKGNLRIKFNIKFPTRLTDEQRAGIKKLLAA

SEQ ID NO: 7646 - protein, 341 aa, Manihot esculenta
MGVDYYKILQVDKNAKDDDLKKAYRKLAMKWHPDKNPNNKKEAEAKFKQISEAYEVLSDPQKRAIYDQYGEEGLKGQMPPPDAGGPGGATFFSTGDGPTTFRFNPRNADDIFAEFFGFSSPFGGMGGGSGMRGGSRSFGGMYSDDIFSSFGEGRPMSSAPRKASAIENKLPCTLEELYKGTTKKMKISREIADASGKTLPVEEILTIDIKPGWKKGTKITFPEKGNEQPNVIPADLVFIIDEKPHSIFTREGNDLITIKKISLAEALTGYTVHLTTLDGRSLTIPINNVIHPDYEEVVPKEGMPIPKDPSKRGNLRIKFNIKFPTRLTAEQKSGIKKLLAP

SEQ ID NO: 7647 - protein, 133 aa, Manihot esculenta
IKPGWKKGTKITFPEKGNEQPNVIPADLVFIIDEKPHSIFTREGNDLITIKKISLAEALTGYTVHLTTLDGRSLTIPINNVIHPDYEEVVPKEGMPIPKDPSKRGNLRIKFNIKFPTRLTAEQKSGIKKLLAP

SEQ ID NO: 7648 - protein, 347 aa, Medicago truncatula
MGVDYYKILQVDKNANDDELKKAYRKLAMKWHPDKNPTNKKDAEAKFKQISEAYEVLADPEKKAIYDQYGEEGLKGQVPPPDAGSGGGTSFYSTGDMPGSFRFNPRNADDIFAEFFGFSSPFGGMGGRGGGGGMRSRFSGGMFGDDMFGSFGEGGGIHMSQAAPRKAPAIENKLSCTLEEIYRGTTKKMKISREIADVSGKTMPVEEILTITVKPGWKKGTKITFPEKGNEQPNVTAADLIFVIDERPHSVFSREGNDLIVTQKISLAEALTGYTVHLTTLDGRNLSIPINNVIHPNYEEVVPKEGMPLPKDPTKKGNLRIKFNIKFPTRLTDEQKAGVRKLLASSA

SEQ ID NO: 7649 - protein, 139 aa, Populus trichocarpa
MGVDYYKILQVDKTAKDDDLKKAYRKLAMKWHPDKNPNNKKEAEAKFKKISEAYEVLSDPQKKAVYDQYGEEGLKGQVPPPGAGGAAVQVGLVQVELHSSPREMGQRHFSSILGMLMTFLLNFSGFRVHLEGWEVVVEA

SEQ ID NO: 7650 - protein, 345 aa, Populus trichocarpa
MGVDYYKILQVDKTAKDDDLKKAYRKLAMKWHPDKNPNNKKEAEAKFKQISEAYEVLSDPQKRAVYDQHGEEGLKGQVPPPGAGGAGPGGASFFSTGDGPTTFRFNPRNADDIFAEFFGSSGPFGGMGGGSGGMRGTRFPGGMFGDAIFSSFGEGGGGSMHQSVPRKAPPIEKRLLCSLEELYKGATKRMKISRDIVDASGKTIQVEEILTIDIKPGWKKGTKITFPEKGNEQPNSKPADLVFIIDEKPHPVFTRDGNDLIVTQKIPLAEALTGYTVHLTTLDGRNLTIPINTVIDPNYEEVVPREGMPIQKDPTKRGNLRIKFNIKFPTRFTAGQKAGIKKLLG

SEQ ID NO: 7651 - protein, 349 aa, Glycine max
MGVDYYKILQVDRSAKDDDLKKAYRKLAMKWHPDKNPNNKKEAEAKFKQISEAYEVLSDPQKRAIYDQYGEEGLKGQVPPPDAGGAGTGTTFFSTGDIPGSFRFNPRNADDIFAEFFGFSSPFGGMGGRGGGGSGGGMRSRFPGGMFGDDMFASFGEGGGVHMSQGASRKAPPIESKLPCTLEEIYKGTTKKMKISREIADASGKTMPVEEILTINVKPGWKKGTKITFPEKGNEQPNVMPADLVFIIDEKPHGVFTRDGNDLVVTQKISLAEALTGYTVHLTTLDGRNLTIPINNVIHPTYEEVVPREGMPLPKDPSKKGNLRIKFNIKFPTRLTEEQKAGIRKLLNA

SEQ ID NO: 7652 - protein, 143 aa, Artemisia annua
MTVEEILNINIKPGWKKGTKITFPEKGNEQPNVTPADLVFVIDEKPHSTFTRDGNDLVVTKRITLAEALTGYTVNLTTLDGRNLTIPINNVIHPEYEEVVPREGMPISKDPTKKGNLRIKFNVKFPTRLTPTQKSKIKELLNG

SEQ ID NO: 7653 - protein, 167 aa, Cleome spinosa
LEDLYKGTTKKMKISREIADVSGKTMQVEEILTIDVKPGWKKGTKITFPEKGNEQPGVIPADLVFVIDEKPHSVFTRDGNDLVVTQKVALTEALAGYTVNLTTLDGRRLTIPINNVIHPEYEEVVPKEGMPLQKDPARKGNLRIKFVIKFPARLTVDQKAGIKKLLG

SEQ ID NO: 7654 - protein, 339 aa, Cucumis sativus
MGIDYYKVLQVDRNAKDDDLKKAYRKLAMKWHPDKNPNNKKEAEAKFKQISEAYEVLSDPQKKEIYDQYGEEGLKGQVPPPDTGGPAGGASFFSTGDRSSTFRFNPRNAEDIYAEFFGSSNPFGGMGGGPRFSSSIFGDDIFTSFRESGGGSMNQASSRKAAPIENRLPCSLEDLYKGTTKKMKISREVSDTTGKIVTVEEILTIDIKPGWKKGTKITFPEKGNEQPNVIPADLVFIIDEKPHSVFTRDGNDLIVTQKISLAEALTGYTVHLNTLDGRSLTIPINNVVNPSYEEVVPREGMPMQKDPTKKGSLRIKFNIKFPSRLTTEQKAGIKKLLGQ

SEQ ID NO: 7655 - protein, 344 aa, Theobroma cacao
MGADYYKILQVDKNAKDDDLKKAYRKLAMKWHPDKNPNNKKEAEAKFKQISEAYEVLSDPQKRAIYDQYGEEGLKGQVPPPDAGGPGGATFFQTGDGPNVFRFNPRNANDIFAEFFGFSSPFGGMGGGGAGSGMRGGSRAFGGMFGDDIFSSFGEGRPMSQAPRKAPPIENTLPCSLEELYNGTTKKMKISREIADASGKTLPVQEILTIDIKPGWKKGTKITFPEKGNEQPNVIPADLVFIIDEKPHSTFTREGNDLVVTQKISLAEALTGYTVHLTTLDGRSLTIPITSVIHPNYEEVVPREGMPIPKEPSRRGNLRIKFNIKFPTRLTAEQKSGIKKLLAP

SEQ ID NO: 7656 - protein, 342 aa, Ricinus communis
MGVDYYKILQVDRSAKDDDLKKAYRKLAMKWHPDKNPNNKKEAEAKFKQISEAYEVLSDPQKRAVYDQYGEEGLKGQVPPPDTSGGTSYFSTGDFPGSVRFNPRSADDIFAEFFGYSSPFGGMGGSGGGMRGPRFSSGMFGDDIFGSYGEGGGGSMHQAGPRKDPPIENRLPCSLEELYKGSTRKMKISREIVDVSGKIMQVQEILTIDIKPGWKKGTKITFPQKGNEHPNVIPADLVFIIDEKPHLVFTRDGNDLIVTQKISLAEALSGYTVHLTTLDGRNLTIPINSVIHPSYEEVVPREGMPIQKDPAKKGNLRIKFNIKFPTRLTSEQKAGIKKLLGS

SEQ ID NO: 7657 - protein, 344 aa, Gossypium hirsutum
MGVDYYKILQVDKNAKDDDLKKAYRKLAMKWHPDKNPNNKKEAEAKFKQISEAYEVLSDPQKRAIYDQYGEEGLKGQVPPQDAGGPGGATFFQTGDGPNVFRFNPRNANDIFAEFFGYSSPFGGMGGSGMRGSSRSFGGMFGDDIFSSFGEGRPMSQNPRKPPPIENTLPCSLEDLYKGTTKKMKISREIADASGKTLPVQEILTIDIKPGWKKGTKITFPEKGNEQPNTIPADLVFIIDEKPHSTFTRDGNDLVVTQKISLAEALTGYTVHLTTLDGRSLNIPINSVIHPNYEEVVPKEGMPIPKDPSKRGNLRIKFNIKFPTRLTAEQKSGIKKLLGPSGGL

SEQ ID NO: 7658 - protein, 183 aa, Gossypium hirsutum
PPPIENTLPCSLEDLYKGTTKKMKISREIADASGKTLPVQEILTIDIKPGWKKGTKITFPEKGNEQPNTIPADLVFIIDEKPHSTFTRDGNDLVVTQKISLAEALTGYTVHLTTLDGRSLNIPINSVIHPNYEEVVPKEGMPIPKDPSKRGNLRIKFNIKFPTRLTAEQKSGIKKLLGPSGGL

SEQ ID NO: 7659 - protein, 342 aa, Vitis vinifera
MGVDYYKILQVDKSSKDEDLKKAYRKLAMKWHPDKNPNNKKEAEAKFKQISEAYEVLSDPQKRAVYDQYGEEGLKGQVPPPDAGVPGGATYFQTGDGPTMFRFNPRNANDIFAEFFGYSSPFGGMGGTGGGGMRGSRFSSGMFGDDIFSSFGDSRPMSQGPRKAPPIENTLPCSLEDLYKGTTKKMKISREIMDASGKTIPVEEILTIEIKPGWKKGTKITFPEKGNEQPNVIPADLVFIIDEKPHSKFTREGNDLVVTQKITLAEALTGYTVHLTTLDGRSLSIPINNAIHPNYEEVVPKEGMPIPKEPSKRGNLRIKFNIKFPTRLTAEQKSGIKKLLGS

SEQ ID NO: 7660 - protein, 141 aa, Arachis hypogaea
VKEILTINVKPGWKKGTKITFPEKGNEQPNVTPADLVFIIDEKPHSVFTREGNDLITTQKISLVEALTGYTVNLTTLDGRNLTIPINSVIHPDYEEVVPREGMPLPKDPSKKGNLRIKFNIKFPSRLSADQKSGIKKLLAG

SEQ ID NO: 7661 - protein, 348 aa, Populus trichocarpa
MGVDYYKVLQVDKTAKDDDLKKAYRKLAMKWHPDKNPNNKKEAEAKFKQISEAYDVLSDPQKRAVYDQYGEEGLKGQVPPPGAGGAGPGASFFSTGDGPTSFRFNPRNADDIFAEFFGFSHPFGGMGGGGGGGVGGMRGARFPGGMFGEDIFKSYGEGGGSMHQGVPRKAAPVENKLRCSLEELYKGASKRMKISREIVDPSGKPEQVEEILTIDIKPGWKKGTKITFPEKGNEMPNVIPADVVFIIDEKPHPIFSRDGNDLILTQKISLAEALTGYTVNLTTLDGRNLTIPINTVIHPNYEEVVPKEGMPIPKDPTKRGNLRIKFSVKFPTRLTAEQKAGIKTLMGP

SEQ ID NO: 7662 - protein, 352 aa, Glycine max
MGVDYYKILQVDRSAKDDDLKKAYRKLAMKWHPDKNPNNKKEAEAKFKQISEAYEVLSDPQKKAIYDQYGEEGLKGQVPPPDAGGAGTGTTFFSTGDMPGSFRFNPRNADDIFAEFFGFSSPFGGMGGRGGGGGGGGGGMRSRFPGGMFGDDMFASFGEGGGIHMSQGAPRKAAPIENKLPCTLEEIYKGTTKKMKISREIADASGKTMPVEEILTINVKPGWKKGTKITFPEKGNEQPNVTPADLVFIIDEKPHSVFARDGNDLVVTQKISLAEALTGYTVHLTTLDGRNLTIPINNVIHPNYEEVVPREGMPLPKDPSKKGNLRIKFNIKFPTRLTDEQKAGIRKLFNNA

SEQ ID NO: 7663 - protein, 341 aa, Quercus alba
MGVDYYKILQVNKNANDEDLKKAYRKLAMKWHPDKNPNNKKEAEAKFKEISEAYEVLSDPQKRAIYDRYGEEGLKGQVPPPDAGGHGGASFFQTGDGPTMFRFNPRNANDIFAEFFGYSSPFGGMGSSGSGMRSSMPFGGMFGDDIFSSFGEGRPMSQGPHKPPPIEKTLPCTLEELYKGTTKKMRISREIMDASGKTLPVEEILTIEIKPGWKKGTKITFPEKGNEQPNVLPADLVFIIDEKPHSTFTRDGNDLVVTQTISLVEALTGYTVRLTTLDGRSLTIPINNVIHPDYEEVVPKEGMPIPKDPSKRGNLRIKFKIKFPTRLTDEQKSGIKKPLAP

SEQ ID NO: 7664 - protein, 344 aa, Gossypium hirsutum
MGVDYYKILQVDKNAKDDDLKKAYRKLAMKWHPDKNPNNKKEAEAKFKQISEAYEVLSDPQKRAIYDQYGEEGLKGQVPPQDAGGPGGATFFQTGDSPNVFRFNPRNANDIFAEFFGYSSPFGGMGGSGMRGSSRSFGGMFGDDIFSSFGEGRPMSQNPRKPPPIENTLPCSLEDLYKGTTKKMKISREIADASGKTLPVQEILTIDIKPGWKKGTKITFPEKGNEQPNTIPADLVFIIDEKPHSTFTRDGNDLVVTQKISLAEALTGYTVHLTTLDGRSLNIPINSVIHPNYEEVVPKEGMPIPKDPSKKGNLRIKFNIKFPTRLTAEQKSGIKKLLGPSGVL

SEQ ID NO: 7665 - protein, 354 aa, Populus trichocarpa
MGVDYYKILQVDKTAKDDDLKKAYRKLAMKWHPDKNPNNKKEAEAKFKKISEAYEVLSDPQKKAVYDQYGEEGLKGQVPPPGAAGAAGGGPGGAGPGGATFFSTGDGPTTFQFNPRNADDIFTEFFGFSSPFGGMGGGGGGMRQTRFQGGMFGNDIFSSYSEGGGGSMHQGAPRKAPQIEKKLPCSLEELYKGATKRMKISRDIADASGKTMQVEEILTIDIKPGWKKGTKITFPEKGNEQPNIVPADLVFIIDEKPHPTFTRDGNDLVVTQKISLTEALTGYTVHLTALDGRNLTIPVNTLIHPNYEEVVPREGMPIQKDPTKRGNLRIKFDIKFPTRLTAEQKAGIKRLLGP

SEQ ID NO: 7666 - protein, 269 aa, Brassica napus
MGDLYALDFDGVLCDSCGESSLSAVKAARVRWPGLFVGVDSALEEWIVDQMHIVRPVVETGYENLLLVRLLLETKMPYIRKSSVAEGLTVDGILESWGKIKPVIMEAWDEDDKDALIDLFGKVRDDWINNDLTTWIGANRFYPGVSDALKFASSKIYIVTTKQGRFAEALLREIAGVIIPPERIYALGSGPKVEVLKLLQNKPEHQGLKLHFVEDRLATLKNVIKEPELDKWNLYLSNWGYNTEKERAEAESISRIQVIELSTFSSKLK

SEQ ID NO: 7667 - protein, 268 aa, Brassica oleracea
  misc_feature (130)..(130): Xaa can be any naturally occurring amino acid
GDLYALDFDGVLCDSCGESSLSAVKAARVRWPGLFVGVDSALEEWIVDQMHIVRPVVETGYENLLLVRLLLETKMPSIRKSSVAEGLTVDGILESWGKIKPVIMEAWDEDDKDALIDLFGKVRDDWINNXLTTWIGANRFYPGVSDALKFASSKIYIVTTKQGRFAEALLREIAGVIIPPERIYALGSGPKVEVLKLLQNKPEHQGLKLHFVEDRLATLKNVIKEPELDKWNLYLSNWGYNTEKERAEAESISRIQVIELSTFSSKLK

SEQ ID NO: 7668 - protein, 248 aa, Brassica napus
MGDLYALDFDGVLCDSCGESSLSAVKAARVRWPGLFVGVDSALEEWIVDQMHIVRPVVETGYENLLLVRLLLETKMPSIRKSSVAEGLTVDGILESWGKIKPVIMEAWDEDDKDALIDLFGKVRDDWINNDLTTWIGANRFYPGVSDALKFASSKIYIVTTKQGRFAEALLREIAGVIIPPERIYALGSGPKVEVLKLLQNKPEHQGLKLHFVEDRLATLKNVIKKPELDKWNLYLSNWGYNTEKERA

SEQ ID NO: 7669 - protein, 269 aa, Cucumis melo
MGDLYALDFDGVLCDSCGESSLSAVKAAKVRWPGLFDDVDSSLENWIVDQMYTVRPVVETGYENLLLVRLLLEMRLPSIRKSSVAEGLTVHGILENWSKLKPVIMEEWGEKNRDALIDLFGKVRDQWIDEDLATWIGANRFYPGVSDALKFASSRIYIVTTKQGRFAEALLRELAGVTIPPERIYGLGTGPKVEVLKMLQKMPEHQGLKLHFVEDRLATLKNVIKEPELDGWNIYLVDWGYNTQKEREEAAGIQRIQLLQLSDFSTKLK

SEQ ID NO: 7670 - protein, 269 aa, Cucumis melo
  misc_feature (16)..(16): Xaa can be any naturally occurring amino acid
MGDLYALDFDGVLCDXCGESSLSAVKAAKVRWPGLFDDVDSSLENWIVDQMYTVRPVVETGYENLLLVRLLLEMRLPSIRKSSVAEGLTVHGILENWSKLKPVIMEEWGEKNRDALIDLFGKVRDQWIDEDLATWIGANRFYPGVSDALKFASSRIYIVTTKQGRFAEALLRELAGVTIPPERIYGLGTGPKVEVLKMLQKMPEHQGLKLHFVEDRLATLKNVIKEPELDGWNIYLVDWGYNTQKEREEAAGIQRIQLLQLSDFSTKLK

SEQ ID NO: 7671 - protein, 268 aa, Manihot esculenta
MGDLYALDFDGVLCDSCGESSLSAVKAAKVRWPDLFDAVDSTLEEWIVDQMFIVRPVVETGYENLLLVRLLLEMRIPSIRKSSVAEGLTVEGILENWSKIKPVIMEAWGENKDALINLFGKVRDEWMDEDLAAWIGANRFYPGVPEALKFASSKVYIVTTKQSRFADTLLRELAGVTIPPERIYGLGTGPKVEVLKQLQQKPEHQGLKLHFVEDRLATLKNVIKEPELDGWNLYLGNWGYNTQKEREEAASIPRIHLLQISDFSKKLK

SEQ ID NO: 7672 - protein, 268 aa, Mimulus guttatus
MADLYALDFDGVLCDSCGESSLSAVKAAKVRWPSLFDGVESSLEDWIVDQMHIVRPVVETGYENLLLVRLLLEIQMPSIRKSSIAEGLTVEEILENWSTIKPVIMAEWDEDRDVLIDLFGKVRDEWIDNDLATWIGANRFYPGVADALKFASSKLYIVTTKQGRFAEALLREIAGVVIPPERIYGLGTGPKVKVLKQLQDMPEHEGLTLHFVEDRLATLKNVIKEPELSKWNLYLGDWGYNTLNERDEAATISRIRILQLSDFSKKLK

SEQ ID NO: 7673 - protein, 268 aa, Gossypium hirsutum
MGDLYALDFDGVLCDSCGESSISAVKAAKVRWPALFDGVDSVLEDWIVDQMHMVRPVVETGYENLLLVRLLVESRLPSIRKSSVAEGLTVEDILENWSKIKPVIMEEWDENRDALIDLFGKVRDEWMDNDLATWIGANRFYPGVPDALKFSSSTIYIVTTKQSRFADALLRELAGVTIPPERIYGLGTGPKVKVLKQLQLRPEHQGMKLHFVEDRLATLKNVIKEPELDGWNLYLGDWGYNTQKEREEAANISRIQLLQLSDFSKKLK

SEQ ID NO: 7674 - protein, 268 aa, Gossypium hirsutum
MGDLYALDFDGVLCDSCGESSISAVKAAKVRWPDLFDGVASVLEDWIVDQMHIVRPVVETGYENLLLVRLLVESRLPSIRKSSVAEGLTVEDILENWSKIKPVIMEEWDENRDALIDLFGKVRDEWMDNDLATWIGANRFYPGVPDALKFSSSTIYIVTTKQSRFADALLRELAGVTIPPERIYGLGTGPKVKVLKQLQLRPEHQGMKLHFVEDRLATLKNVIKEPELDGWNLYLGDWGYNTQKEREEAANISRIQLLQLSDFSKKLK

SEQ ID NO: 7675 - protein, 268 aa, Populus trichocarpa
MGDLYALDFDGVLCDSCGESSLSAVKAAKVRWPVLFDTVDSTLQDWIVDQMHIVRPVVETGYENLLLVRLLLEMRIPSIRKSSVAEGLTVDGILENWSKIKPVIMEEWAENRDALIELFGKVRDEWMDNDLATWIGANRFYPGVPDALKFASSSIYIVTTKQSRFADALLQELAGLKIPPERIYGLGTGPKVEVLKQLQRKPEHQGLKLHFVEDRLATLKNVIKDPELDGWNLYLGDWGYNTHQERGEAASIPRITLLQLTDFSKKLK

SEQ ID NO: 7676 - protein, 268 aa, Solanum phureja
MGDLYALDFDGVLCDSCGESSLSAVKAAKVRWPSLFNGVDSSLEDWIVDQMHVVRPVVETGYENLLLVRLLLESRIPSIRKSSVAEGLTVEGILENWAKIKPIIMAEWNEDKDFLIDLFGKVRDEWMDNDLATWIGANRFYPGVPDALKFASSKLYIVTTKQSRFADALLKGIAGITIPAERIFGLGTGPKVKVLKQLQEMPEHQGLKLHFVEDRLATLKNVIKESELDGWNLYLGDWGYNTQKEREEAAGISRIRVLELSDFSNKLK

SEQ ID NO: 7677 - protein, 268 aa, Solanum melongena
MGDLYALDFDGVLCDSCGESSLSAVKAAKVRWPSLFNGVDSSLENWIVDQMHVVRPVVETGYENLLLVRLLLESRIPSIRKSSVAEGLTVEGILENWAKIKPIIMEEWDEDRDSLIDLFGKVRDEWMDNDLATWIGANRFYPGVPDALKFASSKLYIVTTKQSRFADALLRGLGGTTIPAERIYGLGTGPKVKVLKQLQEMPEHQGLTLHFVEDRLATLKNVIKESELDGWNLYLGDWGYNTQKEREEAASISRIRLLGLSDFSNKLK

SEQ ID NO: 7678 - protein, 268 aa, Solanum lycopersicum
MGDLYALDFDGVLCDSCGESSLSALKAAKVRWPSLFNGVDSSLEDWIVDQMHVVRPVVETGYENLLLVRLLLESIIPSIRKSSVAEGLTVEGILENWSKIKPIIMAEWNEDRDFLIDLFGKVRDEWMDNDLATWIGANRFYPGVPDALKFASSKLYIVTTKQSRFADALLKGIAGITIPAERIYGLGTGPKVKVLKQLQEMPEHQGLKLHFVEDRLATLKNVIKESELDGWNLYLGDWGYNTQKEREEAAGISRIRVLELSDFSNKLK

SEQ ID NO: 7679 - protein, 268 aa, Lotus japonicus
MGELYALDFDGVICDSCGESSLSALKAAKVRWPGLFDGVNSATQDWIVDQMHAVRPVVETGYENLLLVRLLLETRAPSIRKSSVAEGLTVDGILEKWSKLKPVIMEEWGENRDALIDLFGKVRDEWLEQNFATWIGANRIYPGVSDALKFASSRVYIVTTKQSRFADAILRELAGVTIPPERIYGLGSGPKVEVLKQLQKKPEHQGPTLHFVEDRLATLKNVIKEPELDQWNLYLGNWGYNTRKEKEEAAAISRIQVLELSDFSKKLK

SEQ ID NO: 7680 - protein, 268 aa, Populus trichocarpa
MGDLYALDFDGVLCDSCGESSLSAVKAAKVRWPVLFDTVDSTLQDWIVDQMHIVRPVVETGYENLLLVRLLLEMRIPSIRKSSVAEGLTVDGILDNWSKIKPVIMEEWAENRDALIELFGKVRDEWMDNDLATWIGANRFYPGVPDALKFASSSIYIVTTKQSRFADALLQELAGLKIPPERIYGLGTGPKVEVLKQLQRKPEHQGLKLHFVEDRLATLKNVIKDPELDGWNLYLGDWGYNTHQERGEAASIPRITLLQLTDFSKKLK

SEQ ID NO: 7681 - protein, 268 aa, Mimulus guttatus
MGDLYALDFDGVVCDSCGESSLSAVKAAKVRWPSLFDDVDSSLEDWIVDQMHIVRPVVETGYEILLLVRLLLETKIPSIRKSSVAEGLTVEEVLENWLTIKPVIMSEWDENRDALIDLFGKVRDEWLDNDLATWIGANRFYPGVADALKFASSKLYIVTTKQGRFVEALLRELGGIDFPPERIYGLGTGPKVKVLKQLQDMPEHQGLTLHFVEDRLATLKNVINEPELSKWNLYLGDWGYNTPKEREEAARISRIRLLQLSDFSEKLK

SEQ ID NO: 7682 - protein, 268 aa, Tragopogon dubius
MGDLYALDFDGVLCDSCGESSISAVKAAKLRWPELFVTVESSMEDWIVDQMHIVRPVVETGYENLLLVRLLLEIQIPSLRKSSVAEGLTIEGILENWSKIKPVIMEEWSENKDALVDLFGKVRDEWMEKDLATWVGANRFYPGVPDALKFASSQVYIVTTKQGRFADALLRELAGVIIPPERIYGLGTGPKVEVLKMLQKQPEHQGLTLHFVEDRLATLKNVIKEPELNGWNLYLGDWGYNTEKEREEATTYSRIHVLQLSDFSKKLK

SEQ ID NO: 7683 - protein, 268 aa, Vitis vinifera
MGDLYALDFDGILCDSCGESSLSAVKAAKVRWPGLFDGVDSKLEDWIVDQMFIIRPVVETGYENLLLVRLLLEMRLPSIRKSSVVEGLTIEGILENWSKLKPVIMEEWDEKREPLVDLFGKVRDEWMEDDLATWIDANRFYPGVADALKFASSKVYIVTTKQGRFAEALLRELAGVTIPSERIYGLGTGPKVEVLKQLQKQSEHQGLTLHFVEDRLATLKNVIKEPELDGWNLYLGKWGYNTQKEREEAAGISRIQLLELSDFSKKLK

SEQ ID NO: 7684 - protein, 275 aa, Cucumis sativus
MGDLYALDFDGVLCDSCGESSLSAVKAAKVRWPGLFDEVESSLENWIVDQMYTVRPVVETGYENLLLVRLLLEMRLPSIRKSSVAEGLTVHGILENWSKLKPVIMEEWGENRDALIDLFGKVRDQWIDEDLATWIGANRFYPGVSDALKFASSRIYIVTTKQGRFADALLRELAGVTIPPERIYGLGTGPKVEVLKMLQKMPEHQGLKLHCALNVASFVEDRLATLKNVIKESELDGWNIYLVDWGYNTQKEREEAAAIKRIQLLQLSDFSTKLK

SEQ ID NO: 7685 - protein, 236 aa, Brassica oleracea
KMKGMGEGKMGKEDKENKGGGGKTGKADAKTGGGLLGFFKKGKSEKGGGKKGDGGGDKVKSSGGGGGGGGEVHHYDDGPKKGGGKSKGGAHDIDELMKQIKAGGGANKGNHNHSAKGMGGPMGQGVPIGMMGPMGHQGGGAFPAVQGLPMSGGGGYYPPPPQAMNQQQYMEMMMQQQAAAYGGYGGGHGGDMYHPMMYARPYPAVNYAHPPPMPPPHSGPYTDMFSDENPAGCSIM

SEQ ID NO: 7686 - protein, 274 aa, Solanum tuberosum
MAEDGHKVILNVYDLSQGLARQLSTTFLGKAIEGIWHTGVVVYGHEYYFGGGIQHAPAGTTPYGTPVQVVDLGVTHIPKDVFEMYLQEISPRYTAETYSLLTHNCNNFSNEIAQFLVGATIPDYILNLPNEVTNSPMGALIMPMIQQLESTLRANAVPQAPQFRPATVAPASQPTLSVGKSSSSGVYQSKKPESQGGEKKNVPPAVKPVGEQEMTPANGVVKDPLGDARNKVQEEITREFAAIMATGTLRASEAAALATKKVMQRYGDTFAAMN

SEQ ID NO: 7687 - protein, 121 aa, Solanum phureja
MEVHKRKYIHDGEIEPKKQIKTEKNDGTAASVTTAVEDEEVEEFYAILRRIRVAVKYFEKGNAEGGGAGRNLTAAKPWSPNFRQEDFKRAVDGVKERESVEDNAGLDLNADPVTDPNSEAN

SEQ ID NO: 7688 - protein, 470 aa, Lotus japonicus
MATSSIASLNSPSRLLSIPKEPYPSSHFSSNLLKFAAPRTPSSSVSCSLTRDPASVLPLEQRVELNNGALLHQRPDSFGRFGKFGGKYVPETLMHALTELEAAFHSLTADEDFQRELAGILKDYVGRESPLYFAERLTEHYKRPNGEGPHIYLKREDLNHTGAHKINNAVAQALLAKSLGKKRIIAETGAGQHGVATATVCARFGLECIIYMGAQDMERQALNVFRMRLLGAEVRPVHAGTATLKDATSEAIRDWVTNVETTHYILGSVAGPHPYPMMVREFHAVIGKETRKQALEKWGGLPDVLIACVGGGSNAMGLFHEFVDDKDVRLIGVEAAGFGLDSGKHAATLTKGEVGVLHGAMSYLLQDDDGQIVEPHSISAGLDYPGVGPEHSFLKDLGRAEYYSITDEEALEAFKRVSRLEGIIPALETSHALAYLEKVCPTLPNGTKVVLNFSGRGDKDVQTAIKYLKV

SEQ ID NO: 7689 - protein, 471 aa, Glycine max
MAASIPFTGLNSSRVLPIPKEPYHPFSHFPSSMPKFASLRIPSSSVSCSLTRDSSSVVPLEEHDKMGNGSVLLQRPDSFGRFGKFGGKYVPETLMHALSQLEAAFYSLAADEEFQTELAGILKDYVGRESPLYFAERLTEHYKRPNGEGPHIYLKREDLNHTGAHKINNAVAQALLAKRLGKKRIIAETGAGQHGVATATVCARFGLECIIYMGAQDMERQALNVFRMRLLGAEVRPVHSGTATLKDATSEAIRDWVTNVETTHYILGSVAGPHPYPMMVREFHAVIGKETRKQALEKWGGKPDVLIACVGGGSNAIGLFNEFVDDKDVRLIGVEAAGFGLDSGKHAATLTKGEVGVLHGAMSYLLQDDDGQIVEPHSISAGLDYPGVGPEHSFLKDLGRAEYHSITDEEALEAFKRVSRLEGIIPALETSHALAYLEKVCPTLANGAKVVVNFSGRGDKDVQTAIKYLKL

SEQ ID NO: 7690 - protein, 479 aa, Glycine max
MAASIPFTGINSSRVLPIPREPHHPFSHLLSNMSKFASLRTPSSSSASSSSSSVSCSLTKDPYSVVPLEEHSKMDNGSVLLQRPDSFGRFGKFGGKYVPETLMHALTELEAAFYSLSADEEFQKELAGILKDYVGRESPLYFAERLTEHYKRPNGEGPHIYLKREDLNHTGAHKINNAVAQALLAKRLGKKRIIAETGAGQHGVATATVCARFGLECIIYMGAQDMERQALNVFRMRLLGAEVRPVHSGTATLKDATSEAIRDWVTNVETTHYILGSVAGPHPYPMMVREFHAVIGKETRKQALEKWGGKPDILIACVGGGSNAMGLFNEFVDDKDVRLIGVEAAGFGLDSGKHAATLTKGEVGVLHGAMSYLLQDDDGQIVEPHSISAGLDYPGVGPEHSFLKDLGRAEYHSITDEEALEAFKRVSRLEGIIPALETSHALAYLEKVCPTLPNGAKVVVNFSGRGDKDVQTAIKCLKL

SEQ ID NO: 7691 - protein, 494 aa, Phaseolus coccineus
MAASIPFTGLNSSRVLPIPSQPYPSSYFPSNVLKLAPFRTPSTYSSSVSCSATRDPSSVVPLEQHHNLDNGSVLPNRPDSFGRFGKFGGKYVPETLMHALTELEAAFHSLSADEQFQKELAGILKDYVGRESPLYFAERLTEHYKRPNGEGPHIYLKREDLNHTGAHKINNAVAQALLAKSLGKKRIIAETGAGQHGVATATVCARFGLECIIYMGAQDMERQSLNVFRMRLLGAEVRAVHSGTATLKDATSEAIRDWVTNVETTHYILGSVAGPHPYPMMVRDFHAVIGKETRKQALEKWGGKPDVLIACIGGGSNAMGLFTEFVDDKDVTLIGVEAAGFGLDSGKHAATLTKGEVGVLHGAMSYLLQDDDGQIVEPHSISAGLDYPGVGPEHSFLKDLGRAEYHSITDKEALEAFKRVSRLEGIIPALETSHALAYLEKVCPTPSQWNQGWWLTSVVGVTRMFRLPSSTWMFERVIMSCGMGTEVSLHNRET

SEQ ID NO: 7692 - protein, 475 aa, Arachis hypogaea
MASSITSSSSRLFPITRESQPTSHSTLNFSKFASFSSSSSSASGSKASSYISCSLTRDPSVLPLEEQSKLSNGSVLFQRPDSLGRFGKFGGKYVPETLIHALTELEAAFHSLSADEDFQKELAGILRDYVGRESPLYFAERLTEHYKRANGEGPHIYLKREDLNHTGAHKINNAVAQALLAKCLGKKRIIAETGAGQHGVATATVCARFGLECIVYMGAQDMERQALNVFRMRLLGAEVRPVHSGTATLKDATSEAIRDWVTNVETTHYILGSVAGPHPYPMMVREFHAVIGKETRKQALEKWGGKPDVLIACVGGGSNAMGLFHEFVDDKDVRLIGVEAAGFGLDSGKHAATLTKGEVGVLHGAMSYLLQDDDGQIVEPHSISAGLDYPGVGPEHSFLKDIGRAEYYSITDEEALEAFKRVSRLEGIIPALETSHALAYLEKVCPTLPNGAKVVVNFSGRGDKDVHTAIKYLKV

SEQ ID NO: 7693 - protein, 470 aa, Prunus persica
MAASTSASTTCKTHRLITPPLPKPYSSSQLSFKFHKFTPRATTPSSISCTLTRDSAPLQMEDKHENGSLPVLPRPDSFGRFGKYGGKYVPETLMHALTELEAAFHALANDEDFQKELNGILKDYVGRETPLYFAERLTEHYKRPNGEGPHVYLKREDLNHTGAHKINNAVAQALLAKKLGKKRIIAETGAGQHGVATATVCARFGLQCIIYMGAQDMERQSLNVFRMRLLGAEVRPVHSGTATLKDATSEAIRDWVTNVETTHYILGSVAGPHPYPMMVRDFHKVIGRETRKQALEKWGGKPDVLVACVGGGSNAMGLFHEFVEDKDVRLIGVEAAGFGLDSGKHAATLTKGEVGVLHGAMSYLLQDDDGQIVEPHSISAGLDYPGVGPEHSFLKDTQRAEYYSITDEEALEAFKRLSRLEGIIPALETSHALAYLEKLCPTLPDGAKVVLNCSGRGDKDVHTAIKHLKV

SEQ ID NO: 7694 - protein, 462 aa, Aquilegia formosa
MAISNTIASSSSPSSFTTLRRPCKFHQYPLFSYSSIKRSSFSSISCSLTKASSLQMEAANSTISQRPDSFGRFGKFGGKYVPETLMYALSELESAFRLLASDEAFQKELNGILKDYVGRESPLYFAERLTEHYKRPNDEGPLIYLKREDLNHTGAHKINNAVAQALLAKRLGKKRIIAETGAGQHGVATATVCARFGLECIIYMGAQDMERQSLNVFRMRLLGAEVRPVHSGTATLKDATSEAIRDWVTNVESTHYILGSVAGPHPYPMMVREFHAVIGKETRKQAIEKWGGKPDVLVACVGGGSNAMGLFHEFVDDADVRLIGVEAAGHGVDSGKHAATLTKGEVGVLHGAMSYLLQDDDGQIIEPHSISAGLDYPGVGPEHSFLKDLGRAEYYSVTDNEALEAFKRVSRLEGIIPALETSHALAYLEKLCPTLPNGTKVVLNFSGRGDKDVQTAIKYLEV

SEQ ID NO: 7695 - protein, 469 aa, Solanum phureja
MAFSSTVSPKHCRLSSAASSSSHFPKFQIPLQLNKITPCHSSSSKFPPSIVCVLTEKQSMAAQAVDEPAAIQRPDSFGRFGKFGGKYVPETLMHALDELETAFKSLATDEAFQKELDGILRDYVGRESPLYFAERLTEHYKRPNGEGPLIYLKREDLNHTGAHKINNAVAQALLAKRLGKKRIIAETGAGQHGVATATVCARFGLECIIYMGAQDMERQALNVFRMRLLGAEVRAVHSGTATLKDATSEAIRDWVTNVETTHYILGSVAGPHPYPMMVRDFHAVIGKETRKQALEKWGGKPDVLVACIGGGSNAMGLFHEFVDDDNVRLIGVEAAGFGIDSGKHAATLTKGEVGVLHGAMSYLLQDEDGQIVEPHSISAGLDYPGVGPEHSFLKDLGRAEYYSITDEEALEAFKRLSRLEGIIPALETSHALAYLEKLCPTLPNGTRLVLNCSGRGDKDVQTAIKYLKV

SEQ ID NO: 7696 - protein, 468 aa, Solanum lycopersicum
MAFSSTVSPKHCRLSSAASSSSSFPKFQIPLKINNITPCHSSSKFPPSIVCVLTEKQSMAAQAVDEPAAIQRPDSFGRFGKFGGKYVPETLMHALDELETAFKSLATDEAFQKELDGILRDYVGRESPLYFAERLTEHYKRPNGEGPLIYLKREDLNHTGAHKINNAVAQALLAKRLGKKRIIAETGAGQHGVATATVCARFGLECIIYMGAQDMERQALNVFRMRLLGAEVRAVHSGTATLKDATSEAIRDWVTNVETTHYILGSVAGPHPYPMMVRDFHAVIGKETRKQALEKWDGKPDVLVACIGGGSNAMGLFHEFVDDEDVRLIGVEAAGFGVDSGKHAATLTKGEVGVLHGAMSYLLQDEDGQIVEPHSISAGLDYPGVGPEHSFLKDLGRAEYYSITDEEALEAFKRLSRLEGIIPALETSHALAYLEKLCPTLPNGTRVVLNCSGRGDKDVQTAIKYLKV

SEQ ID NO: 7697 - protein, 312 aa, Capsicum annuum
MAFSSTVSPKHHRLSSAAGGGSALPNNFQIPLKLNKITLLPSSLKPPCSITCVLTEKQSMAAAEPAPVHQRPDSFGRFGKFGGKYVPETLMHALHELEIAFNSLANDEAFQKELDGILRDYVGRESPLYFAERLTEHYKRPDGEGPLIYLKREDLNHTGAHKINNAIAQALLAKRLGKKRIIAETGAGQHGVATATVCARFGLECVIYMGAQDMERQALNVFRMRLLGAEVRAVHSGTATLKDATSEAIRDWVTNVETTHYILGSVAGTHPYPMMVREFHAVIGKETRKQALVNGVGNQTCLLHVLVEDQML

SEQ ID NO: 7698 - protein, 473 aa, Gossypium hirsutum
MAATATSTATFRLGNPLSSSSFSSSSVYSSKKLPVNFRKFALQTSPVKSFSVSCTLTRKPVPAAPVSMDSDPNGWQRPDSFGRFGKFGGKYVPETLMSALSELDAAFHSLSKDEKFQEELAGILKDYVGRESPLYFAERLSEHYKRPNGEGPDIYLKREDLNHTGAHKINNAVAQALLAKRLGKKRIIAETGAGQHGVATATVCARFGLQCIIYMGAQDMERQALNVFRMRLLGAEVRAVHSGTATLKDATSEAIRDWVTNVETTHYILGSVAGPHPYPMMVREFHAVIGKETRKQALEKWGGKPDVLVACVGGGSNAMGLFHEFVNDKDVRLIGVEAAGFGLDSGKHAATLTKGEVGVLHGAMSYLLQDEDGQIVEPHSISAGLDYPGVGPEHSFLKDVGRAEYHSVTDEEALEAFKRLSRLEGIIPALETSHALAYLEQLCPTLPNDTKVVVNCSGRGDKDVQTVIKHLQV

SEQ ID NO: 7699 - protein, 471 aa, Gossypium hirsutum
MAATATSTATFRLGNPLSSSSSSSVYSSKKLPVNFRKFALQTSPVKSFSVSCTLTRKPVPAAPVSMDSDPNGWQRPDSFGRFGKFGGKYVPETLMSALSELDAAFHSLSKDEKFQEELAGILKDYVGRESPLYFAERLSEHYKRPNGEGPDIYLKREDLNHTGAHKINNAVAQALLAKRLGKKRVIAETGAGQHGVATATVCARFGLQCIIYMGAQDMERQALNVFRMRLLGAEVRAVHSGTATLKDATSEAIRDWVTNVETTHYILGSVAGPHPYPMMVREFHAVIGKETRKQALEKWGGKPDVLVACVGGGSNAMGLFHEFVNDKDVRLIGVEAAGFGVDSGKHAATLTKGEVGVLHGAMSYLLQDEDGQIIEPHSISAGLDYPGVGPEHSFLKDVGRAEYHSVTDEEALEAFKKLSRLEGIIPALETSHALAYLEKLCPTLPNGTKVVVNCSGRGDKDVQTVIKHLRV

SEQ ID NO: 7700 - protein, 464 aa, Helianthus annuus
  misc_feature (22)..(22): Xaa can be any naturally occurring amino acid
  misc_feature (229)..(229): Xaa can be any naturally occurring amino acid
MAFSSSNIYRATITKPSSSPYXRSNPSQSSLTFTKASTFSPKSFSVSCVMTQQSTNSSAAPAEPALLRPDSLGRFGKFGGKYVPETLMYALSELESAFHALATDHEFQKELDGILKDYVGRESPLYFAERLTEHYKRPNGEGPEIYLKREDLNHTGAHKINNAVAQALLAKKLGKERIIAETGAGQHGVATATVCARFGLKCIIYMGAQDMERQALNVFRMKLLGAEVXAVHSGTATLKDATSEAIRDWVTNVETTHYILGSVAGPHPYPMMVREFHAVIGKETRKQALEKWGGKPDVLVACVGGGSNAMGLFHEFVDDKDVRLIGVEAAGFGLDSGKHAATLTKGEVGVLHGAMSYLLQDDDGQIIEPHSISAGLDYPGVGPEHSFLKDLGRAEYYSITDAEALEAFKRLSRLEGIIPALETSHALAYLEKLCPTLPNGTKVVLNCSGRGDKDVHTAIKHLQV

SEQ ID NO: 7701 - protein, 468 aa, Mimulus guttatus
MAFTAASSSSSASKTQISLTPHSPLTSISPSKFNKFTPPCPLNSRSPSIRCTLTKQHAMVEDRVDPAALLHRPDSFGRFGKFGGKYVPETLMHALTQLEAAFRSLATDDEFQKELDGILRDYVGRETPLYFAERLTEHYKHPDGKGPLIYLKREDLNHTGAHKINNAVAQALLAKRLGKKRIIAETGAGQHGVATATVCARFGLECVIYMGAQDMERQSLNVFRMRLLGAEVRAVHSGTATLKDATSEAIRDWVTNVESTHYILGSVAGPHPYPMMVREFHAVIGKETRKQALDKWGGKPDVLVACVGGGSNAMGLFHEFVEDKDVRLIGVEAAGFGLDSGKHAATLTKGEVGVLHGAMSYLLQDDDGQIIEPHSISAGLDYPGVGPEHSFLKDIGRAEYYSITDEEALEAFKRLSRLEGIIPALETSHALAYLEKLCPTLPHGTKVVLNCSGRGDKDVQTAIKHLKL

SEQ ID NO: 7702 - protein, 467 aa, Mimulus guttatus
GLHSASSSSSASKTQISLTPHSPLTSISPSKFNKFTPPCPLNSRSPSIRCTLTKQHAMVEDRVDPAALLHRPDSFGRFGKFGGKYVPETLMHALTQLEAAFRSLATDDEFQKELDGILRDYVGRETPLYFAERLTEHYKHPDGKGPLIYLKREDLNHTGAHKINNAVAQALLAKRLGKKRIIAETGAGQHGVATATVCARFGLECVIYMGAQDMERQSLNVFRMRLLGAEVRAVHSGTATLKDATSEAIRDWVTNVESTHYILGSVAGPHPYPMMVREFHAVIGKETRKQALDKWGGKPDVLVACVGGGSNAMGLFHEFVEDKDVRLIGVEAAGFGLDSGKHAATLTKGEVGVLHGAMSYLLQDDDGQIIEPHSISAGLDYPGVGPEHSFLKDIGRAEYYSITDEEALEAFKRLSRLEGIIPALETSHALAYLEKLCPTLPHGTKVVLNCSGRGDKDVQTAIKHLKL

SEQ ID NO: 7703 - protein, 467 aa, Solanum lycopersicum
AFSSTVSPKHCRLSSAASSSSSFPKFQIPLKINNITPCHSSSKFPPSIVCVLTEKQSMAAQAVDEPAAIQRPDSFGRFGKFGGKYVPETLMHALDELETAFKSLATDEAFQKELDGILRDYVGRESPLYFAERLTEHYKRPNGEGPLIYLKREDLNHTGAHKINNAVAQALLAKRLGKKRIIAETGAGQHGVATATVCARFGLECIIYMGAQDMERQALNVFRMRLLGAEVRAVHSGTATLKDATSEAIRDWVTNVETTHYILGSVAGPHPYPMMVRDFHAVIGKETRKQALEKWGGKPDVLVACIGGGSNAMGLFHEFVDDEDVRLIGVEAAGFGVDSGKHAATLTKGEVGVLHGAMSYLLQDEDGQIVEPHSISAGLDYPGVGPEHSFLKDLGRAEYYSITDEEALEAFKRLSRLEGIIPALETSHALAYLEKLCPTLPNGTRVVLNCSGRGDKDVQTAIKYLKV

SEQ ID NO: 7704 - protein, 473 aa, Quercus alba
MASAAAATTTTTTPTHSSSSSIRTHRFKPSIHLPFRFRRFTPTYPSASSLAISCTISTRDPPELRMDDNGSSTLLQRPDSFGRFGKFGGKYVPETLMHALSELESAFHALAGDHEFQKELNGILKDYVGRESPLYFAERLTEHYKRPNGEGPLIYLKREDLNHTGAHKINNAIAQALLAKRLGKKRIIAETGAGQHGVATATVCARFGLQCIIYMGAQDMERQALNVFRMRLLGAEVRPVHSGTATLKDATSEAIRDWVTNVETTHYILGSVAGPHPYPMMVREFHAVIGKETRKQALEKWGGGPDVLVACVGGGSNAIGLFHEFVDDKDVRLIGVEAAGFGLDSGKHAATLTKGEVGVLHGAMSYLLQDDDGQIIEPHSISAGLDYPGVGPEHSYLKDIGRAEYYSVTDDEALEAFKRLSRLEGIIPALETSHALAYLEQLCPTLPNGTRVVLNLSGRGDKDVQTAIKRLQL

SEQ ID NO: 7705 - protein, 474 aa, Malus domestica
MAAAASGSASTTCKTHCLIAPPPAKPYSSSTQLPFKFYKFTSRATAAPTSISCTLTRDSAAIQMDEKKDNGAFPVLPRPDSFGRFGKYGGKYVPETLMHALTELEAAFHALANDEGFQNELNGILKDYVGRETPLYFAERLTEHYKRPNGEGPQVYLKREDLNHTGAHKINNAVAQALLAKKLGKKRIIAETGAGQHGVATATVCARFGLQCIIYMGAQDMERQALNVFRMRLLGAEVRPVHSGTATLKDATSEAIRDWVTNVETTHYILGSVAGPHPYPMMVRDFHKVIGRETRKQALEKWGGKPDVLVACVGGGSNAMGLFHEFVDDKDVRLIGVEAAGFGLDSGKHAATLTKGEVGVLHGAMSYLLQDDDGQIIEPHSISAGLDYPGVGPEHSFLKDMGRAEYYSITDEEALEAFKRLSRLEGIIPALETSHALAYLEKLCPTLPDGAKVVLNCSGRGDKDVQTAIKHLKL

SEQ ID NO: 7706 - protein, 470 aa, Arabidopsis thaliana
MAASGTSATFRASVSSAPSSSSQLTHLKSPFKAVKYTPLPSSRSKSSSFSVSCTIAKDPPVLMAAGSDPALWQRPDSFGRFGKFGGKYVPETLMHALSELESAFYALATDDDFQRELAGILKDYVGRESPLYFAERLTEHYRRENGEGPLIYLKREDLNHTGAHKINNAVAQALLAKRLGKKRIIAETGAGQHGVATATVCARFGLECIIYMGAQDMERQALNVFRMRLLGAEVRGVHSGTATLKDATSEAIRDWVTNVETTHYILGSVAGPHPYPMMVRDFHAVIGKETRKQALEKWGGKPDVLVACVGGGSNAMGLFHEFVNDTEVRMIGVEAAGFGLDSGKHAATLTKGDVGVLHGAMSYLLQDDDGQIIEPHSISAGLDYPGVGPEHSFFKDMGRAEYYSITDEEALEAFKRVSRLEGIIPALETSHALAYLEKLCPTLSDGTRVVLNFSGRGDKDVQTVAKYLDV

SEQ ID NO: 7707 - protein, 471 aa, Nicotiana benthamiana
MAFSSSTAQTASPLSSKHCSRLSSSAASSSSYFPKFQIPFKFNEITSCPSSISCVLTKQESMAAREAAEPAVPLRPDSFGRFGKFGGKYVPETLMHALDELETAFKLLATDEAFQKELDGILRDYVGRESPLYFAERLTEHYKRPDGQGPLIYLKREDLNHTGAHKINNAVAQALLAKRLGKKRIIAETGAGQHGVATATVCARFGLECIIYMGAQDMERQALNVFRMRLLGAEVRGVHSGTATLKDATSEAIRDWVTNVETTHYILGSVAGPHPYPMMVREFHAVIGKETRKQALEKWGGKPDVLVACVGGGSNAMGLFHEFVDDEDVRLVGVEAAGFGIDSGKHAATLTKGEVGVLHGAMSYLLQDEDGQIVEPHSISAGLDYPGVGPEHSFLKDLGRAEYYSITDEEALEAFKRLSRLEGIIPALETSHALAYLEKLCPTLPNGTKVVLNCSGRGDKDVHTAIKYLKV

SEQ ID NO: 7708 - protein, 471 aa, Arabidopsis lyrata
MATAGTAATFRPSVSASSKATRLRSPSKRPKFTPLPSSRSRSSSSFSVSCTIAKDPTVFMADTEAAGSDPTMWQRPDSFGRFGKFGGKYVPETLMHALSELETAFYSLATDEDFQRELAEILKDYVGRESPLYFAERLTEHYRRENGEGPLIYLKREDLNHTGAHKINNAVAQALLAKRLGKKRIIAETGAGQHGVATATVCARFGLQCIIYMGAQDMERQALNVFRMRLLGAEVRGVHSGTATLKDATSEAIRDWVTNVETTHYILGSVAGPHPYPMMVRDFHAVIGKETRRQAMEKWGGKPDVLVACVGGGSNAMGLFHEFVDDAEVRMIGVEAAGFGLDSGKHAATLTKGDVGVLHGAMSYLLQDDDGQIIEPHSISAGLDYPGVGPEHSFLKDMGRAEYYSVTDEEALEAFKRVSRLEGIIPALETSHALAHLEKLCPTLSDGTRVVLNFSGRGDKDVQTAIKYLEV

SEQ ID NO: 7709 - protein, 466 aa, Tragopogon dubius
MAFSMTTPAHRTTASPSSSSSLPFLNPYPLQSSLQSKKSVPRPPKSFAVSCVLAKQPMAVVNDELSVLQRPDSFGRFGKYGGKYVPETLMFALSELETAFKALATDHEFQKELDGILKDYVGRESPLYFAERLTEHYKRPNGEGPEIYLKREDLNHTGAHKINNAVAQALLAKKLGKERIIAETGAGQHGVATATVCARFGLQCIIYMGAQDMERQALNVFRMKLLGAEVRPVHSGTATLKDATSEAIRDWVTNVETTHYILGSVAGPHPYPMMVREFHAVIGKETRKQALEKWGGKPDVLVACVGGGSNAMGLFHEFVDDKEVRMIGVEAAGFGLDSGKHAATLTKGEVGVLHGAMSYLLQDDDGQIIEPHSISAGLDYPGVGPEHSFLKDLGRAEYYSITDEEALEAFKRLSRLEGIIPALETSHALAYLEKLCPTLPNGTKVVLNCSGRGDKDVHTAIKHLQV

SEQ ID NO: 7710 - protein, 471 aa, Triphysaria pusilla
MAFSSSLSTASPTSRTLTHHPLHRHSNSTSPLKFSRFAPFCPAHSRCSPIACKLTKMSATAVEKELETAVVAPQRPDSFGRFGKFGGKYVPETLMHALTELEDAFKALATDHEFQKELAGILKDYVGRESPLYFAERLTEHYKSSDGKGPLIYLKREDLNHTGAHKINNAVAQALLAKRLGKLRIIAETGAGQHGVATATVCARFGLQCIIYMGAQDMERQKLNVFRMRLLGAEVRPVHSGTATLKDATSEAIRDWVTNVETTHYILGSVAGPHPYPMMVRDFHAVIGKETRKQALEKWGGKPDVLVACVGGGSNAMGLFHEFVDDEDVRLIGVEAAGFGLDSGKHAATLTLGEVGVLHGAMSYLLQDEDGQIVEPHSISAGLDYPGVGPEHSFLKDIGRAEYYSITDEEALEAFKRLSRLEGIIPALETSHAIAYLEKLCPTLPDGARVVLNCSGRGDKDVHTAINHLKL

SEQ ID NO: 7711 - protein, 465 aa, Solanum tuberosum
STVSPKHCRLSSAASSSSYFPKFQIPLKLNKITPCHSSSSKFPPSIVCVLTEKQSMAAQAVDEPAAIQRPDSFGRFGKFGGKYVPETLMHALDELETAFKSLTTDEAFQKELDGILRDYVGRESPLYFAERLTEHYKRPNGEGPLIYLKREDLNHTGAHKINNAVAQALLAKRLGKKRIIAETGAGQHGVATATVCARFGLECIIYMGAQDMERQALNVFRMRLLGAEVRAVHSGTATLKDATSEAIRDWVTNVETTHYILGSVAGPHPYPMMVRDFHAVIGKETRKQALEKWGGKPDVLVACIGGGSNAMGLFHEFVDDDNVRLIGVEAAGFGIDSGKHAATLTKGEVGVLHGAMSYLLQDEDGQIVEPHSISAGLDYPGVGPEHSFLKDLGRAEYYSITDEEALEAFKRLSRLEGIIPALETSHALAYLEKLCPTLPNGTRLVLNCSGRGDKDVQTAIKYLKV

SEQ ID NO: 7712 - protein, 345 aa, Quercus alba
MGTRSQQLSREEEEEDPPGRGATTISGQSVSTSRSVGSPSSRSEQTMATPASDSTFLRLNHLDIQGDDAGSQGAVASKKKKRGQRAVGGDKSGRGLRQFSMKVCEKVESKGRTTYNEVADELVAEFADPSNSVTSPDQQQYDEKNIRRRVYDALNVLMAMDIISKDKKEIQWKGLPRTSLNDIEELKTERLGLRNRIEKKAAYLQELEEQFVGLQNLIQRNEQLYSSGNAPSGGVALPFILVQTRPHATVEVEISEDMQLVHFDFNSTPFELHDDNYVLKAMKFCERPQVDDMAHNFTADGGEGSSMSNMYQTQIPLPPMSNTTIRPPTSPPLPGILKARVKHEH

SEQ ID NO: 7713 - protein, 342 aa, Cajanus cajan
MGTQPQQTFREEEEEELPGRGTTISGQSMSTSRSVGSPSSRSEQTMATPASDNTFLRLNHLDIHGDDAGSQGAVASKKKKRGQRAVGGDKSGRGLRQFSMKVCEKVESKGRTTYNEVADELVAEFADPSNGVSTPDQQQYDEKNIRRRVYDALNVLMAMDIISKDKKEIQWKGLPRTSLSDIEELKTERLGLRNRIEKKAAYLQELEEQYVGLQKLIQRNEQLYSSGNAPNGGVSLPFILVQTRPHATVEVEISEDMQLVHFDFNSTPFELHDDNYVLKAMKFCERSQNDNATDNPTDGGEGSSMSGLYHAQVPTSVSNPPNRTPSSPPLPGILKARIKNEH

SEQ ID NO: 7714 - protein, 337 aa, Glycine max
MGTQPQQTFREEEEEEMQGHGTTMSGQSMSTSRSVGSPSSRSEQTMATPASDSTFLRLNHLDIHGDDAGSQGTVAKKKKRGQRAVGGDKSGRGLRQFSMKVCEKVESKGRTTYNEVADELVAEFADPINGVSTPDQQQYDEKNIRRRVYDALNVLMAMDIISKDKKEIQWKGLPRTSLSDIEELKSERLGLRNRIEKKAAYLQELEEQYIGLQKLIQRNEQLYSSGNAPNGGVSLPFILVQTRPHATVEVEISEDMQLVHFDFNSTPFELHDDNYVLKAMKFCERSQNDNTTDNSTDGGEGSSIYAQVPTSVSNPPNRPPSSPPLPGILKARVKNEH

SEQ ID NO: 7715 - protein, 789 aa, Arabidopsis thaliana
MATVSGRRRKRKIQLSKLFTLTGAKACFKPDHSKIGRSGFSRVVFCNQPDSPEAESRNYCDNYVRTTKYTLATFLPKSLFEQFRRVANFYFLVVGILSFTPLAPYTAVSAIVPLTFVILATMFKEGVEDWRRKQQDIEVNNRKVRVHRGNGNFDLREWKTLRVGDILKVEKNEFFPADLVLLSSSYEDAVCYVETMNLDGETNLKLKQGLEVTLSLREELNFRDFEAFIKCEDPNANLYSFVGTMDLKGEKYPLSPQQLLLRGSKLRNTDYIYGVVIFTGPDTKVVQNSTDPPSKRSMIERKMDKIIYLMFLMVFSLAFFGSVLFGIWTRDDFQNGVMERWYLKPDDSSIFFDPKRAPMAAIYHFLTALMLNSYFIPISLYVSIEIVKVLQSIFINQDIHMYYEEADKPAHARTSNLNEELGQVGTILSDKTGTLTCNSMEFIKCSIAGTAYGRGVTEVEMAMDKRKGSALVNQSNGNSTEDAVAAEPAVKGFNFRDERIMDGNWVTETHADVIQKFFQLLAVCHTVIPEVDEDTGKISYEAESPDEAAFVIAARELGFEFFTRTQTTISVRELDLVTGERVERLYSVLNVLEFSSSKKRMSVIVQDQDGKLLLLCKGADSVMFERLSESGRKYEKETRDHVNEYADAGLRTLILAYRELDENEYEVFTERISEAKNSVSADREALIDEVTEKIEKNLVLLGATAVEDKLQNGVPDCINKLAQAGIKIWVLTGDKMETAINIGFACSLLRRDMKQIIINLETPEIQQLEKSGEKDAIAGFKGKCTASDN

SEQ ID NO: 7716 - protein, 356 aa, Brassica napus
MGSASGFYSNEGFELDPKWLVDPRHLFVGPKIGEGAHAKVYEGKYRNQTVAIKIIKRGESPEEIAKRDSRFAREIAMLSKVQHKNLVKFIGACKEPMMVIVTELLLGGTLRKYLVSLRPKRLDIRLAVAFALDIARAMECLHSHGIIHRDLKPENLILSADHKTVKLADFGLAREESLTEMMTAETGTYRWMAPELYSTVTLRHGEKKHYNHKVDAYSFAIVLWELILNKLPFEGMSNLQAAYAAAFKNLRPSAEDLPGELGLIVTSCWKEDPNERPNFTEIIQMLLRYLSTVSPPQIVPPPVRRVFSSENVVFSPDSPGTCSLMNVREKDGSGQNVNAADSSEKETKGSFFFCCS

SEQ ID NO: 7717 - protein, 356 aa, Brassica napus
  misc_feature (329)..(329): Xaa can be any naturally occurring amino acid
  misc_feature (336)..(336): Xaa can be any naturally occurring amino acid
MGSASGFYSNEGFELDPKWLVDPRHLFVGPKIGEGAHAKVYEGKYRNQTVAIKIIKRGESPEEIAKRDSRFAREIAMLSKVQHKNLVKFIGACKEPMMVIVTELLLGGTLRKYLVSLRPKRLDIRLAVAFALDIARAMECLHSHGIIHRDLKPENLILSADHKTVKLADFGLAREESLTEMMTAETGTYRWMAPELYSTVTLRHGEKKHYNHKVDAYSFAIVLWELILNKLPFEGMSNLQAAYAAAFKNLRPSAEDLPGELGLIVTSCWKEDPNERPNFTEIIQMLLRYLSTVSPPQIVPPPVRRVFSSENVVFSPDSPGTCSLMNVRXKDGSGQXVNAADSSEKETKGSFFFCCS

SEQ ID NO: 7718 - protein, 357 aa, Arabidopsis lyrata
MGSASGFYSNEDFELDPKWLVDPRHLFVGPKIGEGAHAKVYEGKYRNQTVAIKIIKRGESPEEIAKRDNRFAREIAMLSKVQHKNLVKFIGACKEPMMVIVTELLLGGTLRKYLVSLRPKRLDIRLAVGFALDIARAMECLHSHGIIHRDLKPENLILSADHKTVKLADFGLAREESLTEMMTAETGTYRWMAPELYSTVTLRQGEKKHYNHKVDAYSFAIVLWELILNKLPFEGMSNLQAAYAAAFKNLRPSAEDLPGDLEMIVTSCWKEDPNERPNFTEIIQMLLRYLTTVSSAPQIIPPPNRRVFSSENIVLSPESPGTCSLMSVRDGDVSRQTVNTADSSEKQTKGSFFSCCS

SEQ ID NO: 7719 - protein, 356 aa, Arabidopsis thaliana
MGSASGFYSNEEFELDPKWLVDPRHLFVGPKIGEGAHAKVYEGKYRNQTVAIKIIKRGESPEEIAKRDNRFAREIAMLSKVQHKNLVKFIGACKEPMMVIVTELLLGGTLRKYLVSLRPKRLDIRLAVGFALDIARAMECLHSHGIIHRDLKPENLILSADHKTVKLADFGLAREESLTEMMTAETGTYRWMAPELYSTVTLRQGEKKHYNHKVDAYSFAIVLWELILNKLPFEGMSNLQAAYAAAFKNLRPSAEDLPGDLEMIVTSCWKEDPNERPNFTEIIQMLLRYLTTVSAPQIIPPPNRRVFSSENIVLSPESPGTCSLMSVRDGDVSRQTVNTADSSEKQTKGSFFSCCS

SEQ ID NO: 7720 - protein, 355 aa, Brassica oleracea
  misc_feature (20)..(20): Xaa can be any naturally occurring amino acid
GSASGFYSNEGFELDPKWLXDPRHLFVGPKIGEGAHAKVYEGKYRNQTVAIKIIKRGESPEEIAKRDSRFAREIAMLSKVQHKNLVKFIGACKEPMMVIVTELLLGGTLRKYLVSLRPKRLDIRLAVAFALDIARAMECLHSHGIIHRDLKPENLILSADHKTVKLADFGLAREESLTEMMTAETGTYRWMAPELYSTVTLRHGEKKHYNHKVDAYSFAIVLWELILNKLPFEGMSNLQAAYAAAFKNLRPSAEDLPGELGLIVTSCWKEDPNERPNFTEIIQMLLRYLSTVSPPQIVPPPVRRVFSSENVVFSPDSPGTCSLMNVREKDGSGQNVNAADSSEKETKGSFFFCCS

SEQ ID NO: 7721 - protein, 280 aa, Raphanus sativus
  misc_feature (152)..(152): Xaa can be any naturally occurring amino acid
  misc_feature (171)..(171): Xaa can be any naturally occurring amino acid
MLSKVQHKNLVKFIGACKEPMMVIVTELLLGGTLRKYLVSLRPKRLDIRLAVAFALDIARAMECLHSHGIIHRDLKPENLILSEDHKTVKLADFGLAREESLTEMMTAETGTYRWMAPELYSTVTLRHGEKKHYNHKVDAYSFAIVLWELIXNKLPFEGMSNLQAAYAAAXKNLRPSAEDLPGELGLIVTSCWKEDPNERPNFTEIIQMLLRYLSTVSPPQIVPPPVRRVFSSENVVFSPDSPGTCSLMNVRDKDGSGQNVNAADPSEKETKGSFFFCCS

SEQ ID NO: 7722 - protein, 351 aa, Manihot esculenta
MGSNNAFYSGEFNLDAKWLIDPKLLFVGPKIGEGAHAKVYEGKYKNQNVAIKVVHRGETPEEIAKREARFAREVAMLSRVQHKNLVKFIGACKEPVMVIVTELLLGGTLRKYLLNMRPRCLEMHVAIGFALDIARAMECIHSHGIIHRDLKPENLILTADHKTVKLADFGLAREESLTEMMTAETGTYRWMAPELYSTVTLRHGEKKHYNHKVDAYSFAIVLWELIHNKLPFEGMSNLQAAYAAAFKNVRPSAENLPEDLAMIVTSCWQEDPNARPNFSQIIQMLLRYLSTVSPPEPVIPARIFTSENAVLPPESPGTSSLMAVRDDSGETPKAQMEDKPRGFFFCFNQCY

SEQ ID NO: 7723 - protein, 353 aa, Solanum lycopersicum
MGSANGFYSGEEEFNLEAKWLIDPKLLFVGPKIGEGAHAKVYEGKYRNQNVAIKIVHKGETPEEIAKRESRFGREVAMLSRVQHKNLVKFIGACKEPVMVIVTELLLGGTLRKYLLNLRPRCLDTGVAIRFALDIARAMECLHSHGIIHRDLKPENLLLTADHKTVKLADFGLAREESLTEMMTAETGTYRWMAPELYSTVTLRHGEKKHYNHKVDAYSFAIVLWELVHNKLPFEGMSNLQAAYAAAFKNVRPSADDLPEDLAVIVTSCWKEDPNTRPNFTQIIQMLLHFLSSVSPPEPVIPARIFTSENHVLPPESPGTSSLMSKRDDSVETPKTPMENQPRGFFFCFNQCY

SEQ ID NO: 7724 - protein, 565 aa, Raphanus sativus
  misc_feature (264)..(264): Xaa can be any naturally occurring amino acid
MVVVGNVSAANLPYQNGFLKAISSGGCDLMGHRSFRISTCSQALKTRTRRSAGPLQVVCVDIPRPELENTVNFLEAASLSASFRSAPRPAKPLKVVIAGAGLAGLSTAKYLADAGHIPLLLEARDVLGGKIAAWKDEDGDWYETGLHIFFGAYPNVQNLFGELGINDRLQWKEHSMIFAMPSKPGEFSRFDFPDVLPAPLNGIWAILRNNEMLTWPEKIKFAIGLLPAMVGGQAYVEAQDGLSVEEWMRKQGVPDRVTDEVFIXMSKALNFINPDELSMQCILIALNRFLQEKHGSKMAFLDGNPPERLCMPIVEHIRSLGGEVRLNSRIRKIELEDDGTVKNFLLTDGTTIQGDAYVFATPVDILKLLLPDSWKEIPYFKRLEKLVGVPVINVHIWFDRKLKNTYDHLLFSRSNLLSVYADMSLTCKEYYDPNRSMLELVFAPAEEWISRTDSDIIDATMKELEKLFPDEIAADQSKAKILKYHVVKTPRSVYKTIPDCEPCRPLQRSPIQGFYLAGDYTKQKYLASMEGAVLSGKFCSQSIVQDYELLAASGRRNLSETTVST

SEQ ID NO: 7725 - protein, 566 aa, Arabidopsis thaliana
MVVFGNVSAANLPYQNGFLEALSSGGCELMGHSFRVPTSQALKTRTRRRSTAGPLQVVCVDIPRPELENTVNFLEAASLSASFRSAPRPAKPLKVVIAGAGLAGLSTAKYLADAGHKPLLLEARDVLGGKIAAWKDEDGDWYETGLHIFFGAYPNVQNLFGELGINDRLQWKEHSMIFAMPSKPGEFSRFDFPDVLPAPLNGIWAILRNNEMLTWPEKIKFAIGLLPAMVGGQAYVEAQDGLSVKEWMEKQGVPERVTDEVFIAMSKALNFINPDELSMQCILIALNRFLQEKHGSKMAFLDGNPPERLCMPVVDHIRSLGGEVQLNSRIKKIELNDDGTVKSFLLTNGSTVEGDAYVFAAPVDILKLLLPDPWKEIPYFKKLDKLVGVPVINVHIWFDRKLKNTYDHLLFSRSNLLSVYADMSLTCKEYYDPNRSMLELVFAPAEEWISRTDSDIIDATMKELEKLFPDEISADQSKAKILKYHVVKTPRSVYKTIPNCEPCRPLQRSPIEGFYLAGDYTKQKYLASMEGAVLSGKFCSQSIVQDYELLAASGPRKLSEATVSSS

SEQ ID NO: 7726 - protein, 569 aa, Arabidopsis lyrata
MVVFGNVSAANLPYQNGFLEALSSSGGIELMGHSFRVPTFQAPKTRTRRRSTAGPLQVVCVDIPRPELENTVNFLEAASLSASFRSAPRPAKPLKVVIAGAGLAGLSTAKYLADAGHKPLLLEARDVLGGKIAAWKDEDGDWYETGLHIFFGAYPNVQNLFGELGINDRLQWKEHSMIFAMPSKPGEFSRFDFPDVLPAPLNGIWAILRNNEMLTWPEKIKFAIGLLPAMVGGQAYVEAQDGLSVKEWMEKQAIPERVTDEVFIAMSKALNFINPDELSMQCILIALNRFLQEKHGSKMAFLDGNPPERLCMPIVDHIRSLGGEVQLNSRIKKIELNNDGTVKSFLLTNGSTVEGDAYVFAAPVDILKLLLPDPWKEIPYFKKLDKLVGVPVINVHIWFDRKLKNTYDHLLFSRSNLLSVYADMSLTCKEYYDPNRSMLELVFAPAEEWISRTDSDIIDATMKELEKLFPDEISADQSKAKILKYHVVKTPRSVYKTIPNCEPCRPLQRSPIEGFYLAGDYTKQKYLASMEGAVLSGKFCSQSIVQDYELLAASGSRKLSEATVSSSSS

SEQ ID NO: 7727 - protein, 578 aa, Quercus alba
MTIGGFVSAANLSCQSTLTGNQTLRCGFLNNSVKTNALAFGGCESMGHSLRIPHTKAIRLRPRKGVSPLQVVCMDFPRPELENTVNFLEAAYLSSSFRASARPSKPLTVVIAGAGLAGLSTAKYLADAGHKPILLESRDVLGGKVAAWKDDDGDWYETGLHIFFGAYPNVQNLFGELGIDDRLQWKEHSMIFAMPNKPGEFSRFDFPEVLPAPLNGIWAILKNNEMLTWPDKVKFAIGLLPAMLGGQAYVEAQDGLTVKEWMRKQGVPDRVTDEVFVAMSKALNFINPDELSMQCILIALNRFLQEKNGSKMAFLDGNPPERLCMPIVDHIQSLGGEVRLNSRIQKIELNNDGTVKSFLLNNGNMIEGDAYVFATPVDILKLLLPENWKEIPYFQRLKKLVGVPVINVHIWFDRKLKNTYDHLLFSRSPLLSVYADMSVTCKEYYNPNQSMLELVFAPAEEWISRSDSDIIDATMNELARLFPDEISTDQSKAKIVKYHVVKTPRSVYKTVPDCEPCRPLQRSPIEGFYLAGDYTKQKYLASMEGAVLSGKLCAQAIVQDHELLIARGQTRLAQASVY

SEQ ID NO: 7728 - protein, 597 aa, Ricinus communis
MALYGGVSALNLSWHSDVLDTRNLQSALRCGYATCSNQTNVLAFRGSESMGHALRNSSKTRFRNTGSCPLKVVCVDYPRPDLDNTVNFLEAAYLSSSFRSSSPPDKPLKVVIAGAGLAGLSTAKYLADAGHKPLLLEARDVLGGKVAAWKDDDGDWYETGLHIFFGAYPNVQNLFGELGINDRLQWKEHSMIFAMPNKPGEFSRFDFPDVLPAPLNGIWAILRNNEMLTWPEKVKFAIGLLPAMVGGQAYVEAQDGLSVQEWMRKQGVPDRVTKEVFIAMSKALNFINPDELSMQCILIALNRFLQEKHGSKMAFLDGNPPERLCMPIVDHVQSLGGEVRLNSRIKKIELNNDGAVKNFLLNNGEVIEGDVYVVATPVDILKLLLPDNWKEIPYFKKLDKLVGVPVINVHIWFDRKLKNTYDHLLFSRSPLLSVYADMSVTCKEYYNPNQSMLELVFAPAEEWVSRSDEEIIEATMMELAKLFPDEISADQSKAKIVKYHVVKTPRSVYKTVPNCEPCRPLQRSPIEGFYLAGDYTKQKYLASMEGAVLSGKYCAQAIVQDYGLLIARKQKKLAETSGMHITELYCRRLSSVVYGLY

SEQ ID NO: 7729 - protein, 320 aa, Brassica napus
MACQNNLVVKQIIDLYDQISKLECLKPSKNVDTLFGQLVSTCLPTDINIDVTKMSDEVKDMRSNLIKLCGEAEGYLEQHFSTILGSLPGDQNPLDHLNIFPYYNNYLKLGKLEFDLLSQHSSHVPNKIAFVGSGPMPLTSIVLAKFHLKNTTFHNFDIDSHANTLASSLVSRDPDLSKRMIFHTTDVLNATEGLDQYDAVFLAALVGMDKEAKVKAIEHLEKHMAPGAILMLRSAHALRAFLYPIVDSSDLKGFQLLTIYHPTDDVVNSVVIARKLGGSSMTGVNGTRGCMFMPCNCSKVHAIMNNRCKKLMIEEFSAIE

SEQ ID NO: 7730 - protein, 96 aa, Raphanus sativus
  misc_feature (3)..(3): Xaa can be any naturally occurring amino acid
  misc_feature (9)..(10): Xaa can be any naturally occurring amino acid
  misc_feature (13)..(13): Xaa can be any naturally occurring amino acid
  misc_feature (62)..(62): Xaa can be any naturally occurring amino acid
  misc_feature (72)..(72): Xaa can be any naturally occurring amino acid
  misc_feature (90)..(90): Xaa can be any naturally occurring amino acid
  misc_feature (94)..(94): Xaa can be any naturally occurring amino acid
MAXQNNLVXXQIXDLYDQISKLECLKPSKNVDTLFGQLVSTCLPTDTNIDVTKMSDEVKDMXSNLIKLCGEXEGYLEQHSPQSWGLYQKXKTHXTI

SEQ ID NO: 7731 - protein, 320 aa, Raphanus sativus
  misc_feature (13)..(13): Xaa can be any naturally occurring amino acid
  misc_feature (54)..(54): Xaa can be any naturally occurring amino acid
  misc_feature (215)..(215): Xaa can be any naturally occurring amino acid
  misc_feature (319)..(319): Xaa can be any naturally occurring amino acid
MACENNLVVKQIXDLYTQISNLESLKPSKNVDTLFGQLVSTCLPTDTDIDVTKXHDEKVKDMRSHLIKLCGEAEGYLEQHFSTIIGSFEDNPLNHLHIFPYYNNYLKLSKLEFDLLAQHTSHVPTKIAFIGSGPMPLTSIVLAKFHLPNTTIHNFDIDSQANTLASSLVSRDPDLSERMIFHTTDVLNAKEGLDQYDVVFLAALVGMDKESKVKXIEHLEKHMAPGAVLMLRSAHGLRAFLYPIVDSCDLKGFEVLTIYHPSDDVVNSVVVARKLGGSSEAGSSQIERCVIMPCNCSKIHAIMNSRGMKKNMIEEFSAXE

SEQ ID NO: 7732 - protein, 320 aa, Arabidopsis lyrata
MACENNLVVKQIIDLYNQISNLESLKPSKNVDTLFGQLVSTCLPTDTNIDVTEIHDEKVKDARSHLIKLCGEAEGYLEQHFSTILSSFEDNPLNHLHIFPYYNNYIKLGKLEFDLLAQHTTHVPTKVAFIGSGPMPLTSIVLAKFHLPNTTFHNFDIDSHANTLASNLVSHDSDLSKRMIFHTTDVLNAKEGLDQYDVIFLAALVGMDKESKVKAIEHLEKHMAPGAVLMLRSAHGLRAFLYPIVDSCDLKGFEVLTIYHPSDDVVNSVVIARKLGGSNGARGSQIGRCVVMPCNCSKVHAIMNNRGMEKNLIEEFSAIE

SEQ ID NO: 7733 - protein, 320 aa, Arabidopsis thaliana
MACENNLVVKQIMDLYNQISNLESLKPSKNVDTLFRQLVSTCLPTDTNIDVTEIHDEKVKDMRSHLIKLCGEAEGYLEQHFSAILGSFEDNPLNHLHIFPYYNNYLKLGKLEFDLLSQHTTHVPTKVAFIGSGPMPLTSIVLAKFHLPNTTFHNFDIDSHANTLASNLVSRDSDLSKRMIFHTTDVLNAKEGLDQYDVVFLAALVGMDKESKVKAIEHLEKHMAPGAVVMLRSAHGLRAFLYPIVDSCDLKGFEVLTIYHPSDDVVNSVVIARKLGGSNGARGSQIGRCVVMPCNCSKVHAILNNRGMEKNLIEEYSAIE

SEQ ID NO: 7734 - protein, 424 aa, Brassica napus
MATTPMCTEWQFSGNEAAKEAAAAALGAYTSKLMALCDPNGKPILPPSNKAVETSNSAEKAVVKVILSGTGNAYAPSIGLPLAKSAVAEYLNRDLPKKLTAADVFMTVGCKRAIDLAVDILAKPKANVLLPRPGFPWDVVRCIYKKLEVRYYDFIPEQNFEIDFESVKKVTDKNTFAIFIINPHNPNGNTYSEAHLKQLAELAKELSIMVVSDEVFRWTVFGNNPFVPMGKFSSIVPVVTLGSLSKGWNVPGWRTGWLALHDLDGVFRNTKILQAANEFLQINAKPPTVIQAAMPDILERTPKHFFHERGSFLKHKVDIGYSKVKHIPGLTCYMKPEACTFLWTKLDISCFADIEDDQDFCRKLAMEENLVVLPGIAFRQKNWLRHSIDMETPTVEDAFERLKSFCERHSAERGASLKNVNGVN

SEQ ID NO: 7735 - protein, 427 aa, Brassica oleracea
MAIMATTPMCTEWQFSGNEAAKEAAAAALGAYTSKLMALCDPNGKPILPPSNKAVETSNSAEKAVVKFILSGTGNAYAPSIGLPLAKSAVAEYLNRDLPKKLTAADVFMTVGCKRAIDLAVDILAKPKANVLLPRPGFPWDVVRCIYKKLEVRYYDFIPEQNFEIDFESVKKVTDKNTFAIFIINPHNPNGNTYSEAHLKQLAELAKELSIMVVSDEVFRWTVFGNNPFVPMGKFSSIVPVVTLGSLSKGWNVPGWRTGWLALHDLDGVFRNTKILQAANEFLQINAKPPTVIQAAMPDILERTPKHFFHERGSFLKHKVDIGYSKVKHIPGLTCYMKPEACTFLWTKLDISCFADIEDDQDFCRKLAMEENLVVLPGIAFRQKNWLRHSIDMETQTVEDAFERLKSFCERHSAERGASLKNVNGVN

SEQ ID NO: 7736 - protein, 424 aa, Raphanus sativus
MATTPKCTEWQFSGSEAAKEAAAAALGAYTSKLMALCDPNGKPILPPNKKAIETSNSAEKAVVKVVLSGTGNAYAPSIGLPVAKSAVAEYLNRDLPKKLTADDVFMTVGCKRAIDLAVDILAKPKANVLLPRPGFPWDVVRSIYKKLEVRYYDFIPEQNFEIDFESVKKVTDKNTFAIFIINPHNPNGNTYSEAHLKQLAELAKELSIMVVSDEVFRWTVFGNNPFVPMGKFSSIVPVVTLGSLSKGWNVPGWRTGWLALHDLDGVFRNTKILEAANEFLQINAKPPTVIQAAMPDILERTPKHFFLERGSFLKHKVDIGYAKLKHIPGLTCYMKPEACTFLWTKLDISCFADIGDDQEFCSKLAMEENLVVLPGIAFRQPNWLRHSIDMETPTVEDAFERLKSFCERHSTKGGASLKNANGVN

SEQ ID NO: 7737 - protein, 423 aa, Thellungiella halophila
MMNQKCIEWQFSGSEAAKEAAAASLGTYTSELYAMCDPNGKPILPPRSESPETSPAAEKAVVKAVLCGTGNAYAPSIGLPVAKRAVAEYLNQNLPKKLTADDVFMTVGCKQAIELAVDILAKPKANVLLPRPGFPWDVVRSIYKHLEVRYYDFIPEKDFEIDFDSVRKMVDKNTFAIFIINPHNPNGNTYSECHLKQLAELAKELSIMVVSDEVYRWTVFGSNPFVPMGKFSSIVPVVTLGSISKGWSVPGWRTGWLALHDLDGVFKSTKILQAAKEFLEINSKPPTVIQAAIPDILERTPKEFFDKRGSFLKDKVDFGYSKLKHIPNLTCYMKPEACTFLWTELDLSCFVSIEDDQDFCKKLAMEENLVVLPGIAFSQKNWLRHSIDMDTPTLEDAFERLKSFCERHSITGEASLKNVNGVN

SEQ ID NO: 7738 - protein, 134 aa, Raphanus sativus
MGLLDHLWDDTVAGPRPDNGLGKLRRHHTFSFRPSSGNDQSDGGSVRSYGEVSPEEAVKVTRSIMIIKPPGYQGGSAPVSPAGSTPPVSPFSEQTQEERNPFGLGEGRRRTRSIREQDQRMDQGTLLLLTACDL

SEQ ID NO: 7739 - protein, 134 aa, Raphanus sativus
MGLLDHLWDDTVAGPRPENGLGKLRRHHTFSFRPSSTNDQSDGGSVRSYGEESPEEAVKVTRSIMIIKPPGYQGGSAPVSPAGSTPPVSPFSEQTQEERNPFGLGEGRRRMRSIREQDQRMDQGTLLLLTACDL

SEQ ID NO: 7740 - protein, 134 aa, Unknown
  Sequence found in Organisms: Brassica napus, Brassica oleracea
MGLLDHLWDDTVAGPRPENGLGKLRRHHTFSFRASSGNDQSDGGSVRSYGGDSPEEAVKVTRSIMIIKPPGYQGGSAPVSPAGSTPPVSPFSEQTQEERNPFGLGEGRRRTRSIREQNQRMDQGTLLLLTACDL

SEQ ID NO: 7741 - protein, 100 aa, Raphanus sativus
MGLLDHLWDDTVAGPRPDNGLGKLRRHHTFSFRPSSVNDQSDGGSVRSYGEVSPEEAVKVTRSIMIIKPPGYQGGSAPVSPAGSTPPVSPFSWRKGTLSV

SEQ ID NO: 7742 - protein, 128 aa, Thellungiella halophila
MGLLDHLWDDTVAGPRPENGLGKLRKHHTFSFRPSSGNDQSDGGSVRSYGEDSPEEAVKVTRSIMIVKPPGYQGGSAPVSPAGSTPPVSPFSGGKEPFRFRRRSTSDAFDKAAGSESGPRSSPPTYGV

SEQ ID NO: 7743 - protein, 133 aa, Brassica oleracea
MGLLDHLWDDTVAGPLPENGLGKLRKHHTFSFRPSSANDQSDVRSYGGDSPEEAVKVTRSIMIIKPPGYQGGSAPVSPAGSTTPVSPSPFSEQTQEERNPFGLGEGRHRTRSIRQQDQGMDQGTLLLLTACDL

SEQ ID NO: 7744 - protein, 135 aa, Raphanus sativus
MGILDHLWDDTVAGPRPENGLGKLRKHHTFSFRPSSGNDQPDSGNVRSYGEDSPDEGVKVTRSIMIIKPPGYQGGSTPVSPAGSTPPVSPFSEQTQEERNPFGSGDARLRTRSRRQQADQRMDQGTLLLLTACDL

SEQ ID NO: 7745 - protein, 129 aa, Raphanus sativus
MGILDHLWDDTVAGPRPENGLGKLRKHHTFSFRPSSGNDQSDGGSVRSYGEDSPDEGVKVTRSIMIIKPPGYQGGSAPVSPAGSTPPVSPFSGGKEPFRFRRRSTSDAFEKAAGRSENGPRNSPPTYGV

SEQ ID NO: 7746 - protein, 128 aa, Brassica napus
MGILDHLWDDTVAGPRPENGLGKLRKHHTFSFRPSSGNDQSDGGNVGSYGEDSLDEGLKVTRSIMIIKPPGYQGGSAPVSPAGSTPPVSPFSGGKEPFRFRRRSTSDAFEKAAGSENGPRNSPPTYGV

SEQ ID NO: 7747 - protein, 127 aa, Brassica napus
MGLLDHLWDDTVAGPLPENGLGKLRKHHTFSFRPSSANDQSDVRSYGGDSPEEAVKVTRSIMIIKPPGYQGGSAPVSPAGSTTPVSPSPFSGGKEPFRFRRRSASDAFDKAAGSENGPRNSPPTYGV

SEQ ID NO: 7748 - protein, 129 aa, Raphanus sativus
MGILDHLWDDTVAGPRPENGLGKLRKHHTFSFRPSSGNDQPDSGNVRSYGEDSPDEGVKVTRSIMIIKPPGYQGGSAPVSPAGSTPPVSPFSGGKEPFRFRRRSTSDAFEKAAGRSENGPRNSPPTYGV

SEQ ID NO: 7749 - protein, 127 aa, Brassica oleracea
MGILDHLWDDTVAGPRPENGLGKLRKHHTFSFRPSFGNDQSGGGDSPEEALKVTRSIMIIKPPGYQGGSAPVSPAGSTPPVSPFSEQTQEERNPFGSGDARPRTRSRRDQDQRMDQGTLLLLTACDL

SEQ ID NO: 7750 - protein, 127 aa, Brassica rapa
MGLLDHLWDDTVAGPLPENGLGKLQKHHTFSFRPSSANDQSDVRSYGGDSPEEAVKVTRSIMIIKPPGYQSGSAPVSPAGSTTPVSPSPFSGGKEPFRFRRRSASDAFDKAAGSENGPRKSPPTYGV

SEQ ID NO: 7751 - protein, 130 aa, Raphanus sativus
LIHGHTRSSMGDTVAGPRPENGLGKLRKHHTFSFRPSSGNDQPDSGNVRSYDEDSPDEGVKVTRSIMIIKPPGYQGGSTPVSPAGSTPPVSPFSGGKEPFRFRRRSTSDAFEKAAGSENGPRNTPPTYGV

SEQ ID NO: 7752 - protein, 127 aa, Brassica napus
MGILDHLRDDTVAGPRPENGLGKLRKQHTFSFRPSSGNDQSDGGDSPEEALKVTRNIMIIKPPGYQGGSAPVSPAGSTPPVSPFSEQTQEERNPFGSGDARPRTRWRRNQDQRMDQGTLLLLTACDL

SEQ ID NO: 7753 - protein, 121 aa, Unknown
  Sequence found in Organisms: Brassica napus, Brassica rapa
MGILDHLWDDTVAGPRPENGLGKLRKQHTFSFRPSSGNDQSDGGDSPEEALKVTRSIMIIKPPGYQGGSAPVSPAGSTPPVSPFSGGKEPFRFRRRSTSDALEKEPGSENGPRNSPPTYGV

SEQ ID NO: 7754 - protein, 129 aa, Cleome spinosa
MGLLDHLWDDTVAGPRPENGLGKLRKHHTFSFRPSSGNDQSEGGSVRSYGEDSPEEAVKVTRSIMIVKPPGYQGGSAPVSPAGSTPPVSPFSGGGKEPFRFRRRSTSDAFEKANDEAGRPRSSAPPYGV

SEQ ID NO: 7755 - protein, 137 aa, Arabidopsis thaliana
MGLLDHLWDDTVAGPRPENGLGKLRKHHTFSFRPSSGNDQSEAGSARSYGEDSLPEEAVKVTRSIMIIKPPGYQGSSAPASPAGSTPPLSPFSPPLSPFSGGKEPFRFRRRSTSDAFEKAAGGSETGPRSSPPTYGM

SEQ ID NO: 7756 - protein, 122 aa, Brassica napus
MGLLDHLWDDTVAGPLPENGLGKLRKHHTFSFRPSSANDQSEVRSYGGDSPEEAVKVTRSIMIIKPPGYQSGSAPVSPASSTTPEERNPFGLGEGRHRTCSIRQQDQRMDQGTLLLLTACDL

SEQ ID NO: 7757 - protein, 122 aa, Brassica napus
MGLLDHLWDDTVAGPLPENGLGKLRKHHTFSFRPSSANDQSEVRSYGGDSPEEAVKVTRSIMIIKPPGYQSGSAPVSPASSTTPEERNPFGLGEGRHRTRSIRQQDQGMDQGTLLLLTACDL

SEQ ID NO: 7758 - protein, 126 aa, Cleome gynandra
MGLLDHLWDDTVAGPRPENGLGKLRKHHTFSFRPSSGNDQPEGGSVKSYGEESPEEAVKVTRSIMIVKPPGYQGGSAPVSPASSTPPVSPFSGGKESFLFRRRSTLDAFEKASETGSRGSPPPYRV

SEQ ID NO: 7759 - protein, 143 aa, Arabidopsis lyrata
MGLLDHLWDDTVAGPRPENGLGKLRKHHTFSFRPSSGNDQPEAGSARSYGEDSLPEEAVKVTRSIMIVKPPGYQGGSAPASPASPAGSTPPLSPFSPPLSPFSANAGGKEPFRFRRRSTSDAFVKAAGGSETGPRSSPPTYGM

SEQ ID NO: 7760 - protein, 124 aa, Brassica napus
MGILDHLWDDTVAGPRPENGLGKLRKHHTFSFRPSSGNDQLDGGNVGSYGGDSPDEGLKVTRSIMIIKPPGYQGGSAPVSPAGSTPPISPLSEQTQGRLRTRSRRQQDQRMDQGTLLLLTACDL

SEQ ID NO: 7761 - protein, 160 aa, Brassica juncea
QLHNVFVYGSFQEPEVVKVMLDRTPEIIPVTLPGFKRFRLKGRLYPCVIPCEDGEVKGQLLMGLTDEELENVDAVEGNEYERVTVGVVREDNSEKMTVKTYIWLNKDDPDIGGEWDFEEWKRLHMKLFIEKFKEIMEWKRNPQGKGRDDFNHVLRDAPSA

SEQ ID NO: 7762 - protein, 166 aa, Raphanus sativus
MSGSGTQLHNVFVYGSFQEPEVVKVMLDRTPEIISVTLPGFKRFRLKGRQYPCVIPSEDGEVHGKLLMGLTDEELENLDTVEGNEYERVTVGVVREDNSEKMTVKTYIWINKDDPDIGGEWDFEEWKRLHMKEFIKTFKEIMEWKRNPQGKGRDEFNNALRDAPSV

SEQ ID NO: 7763 - protein, 166 aa, Raphanus sativus
MSGSGAQLHNVFVYGSFQEPEVAKVMLDRTPEIISVTLPGFKRFRLKGRLYPCVIPSEDGEVHGKLLMGLTDEELGHLDTVEGNEYERVTVGVVREDNSEKMTVKTYIWINKDDPDIGGEWDFEEWKRLHMKEFIKTFKEIMEWKRNPQGKGRDEFSKALRDAPSV

SEQ ID NO: 7764 - protein, 166 aa, Raphanus sativus
MSGSGAQLHNVFVYGSFQESEVVKVMLNRTPEIISVTLPGFKRFRLKGRLYPCVIPSEDGEVHGKLLMGLTDEELENLDAAEGNQYERVTVGVVREDNSEKMTVKTYIWINKDDPDIGGEWDFEEWKRLHMKEFIETFKEIMEWKKNPQGKGRDEFNNALRNAPSV

SEQ ID NO: 7765 - protein, 166 aa, Raphanus sativus
MSGSGAQLHNVFVYGSFQEPEVVKVMLDRTPETIFATLPGFKRFRLNGRLYPCVIPSEDGEVHGKLLMGLTDEELENLDAVEGNEYERVTVGVVPEDNFEKMTVETYIWINKDDPDIGGEWDFEEWKRLHMKEFIETFKKIMEWKRNPQGKGRDVFNNALRDAPSV

SEQ ID NO: 7766 - protein, 131 aa, Brassica juncea
MSGSGAQLHNVFVYGSFQEPEVVKVMLDRTPEIISVTLPGFKRFRLEGRLYPCAIASEDGEIHGKLIMGLTDEELENVDAVEGNDYERVTVDVVREDNSEKMTVYTYIWINKDDPGIGGEWDFEAWKRLHM

SEQ ID NO: 7767 - protein, 557 aa, Arabidopsis thaliana
MASLALSGSCSLAFPLKSRSLSLPRPPSSSLNLTKPLRSLDSRFSLLKSPLPVSLRRRSSTLVKASSTVASASSSPTPPLVPAPVPWQGAAIKPLLASIATGLILWFVPVPEGVTRNAWQLLAIFLATIVGIITQPLPLGAVALMGLGASVLTKTLTFAAAFSAFGDPIPWLIALAFFFARGFIKTGLGNRVAYQFVRLFGSSSLGLGYSLVFSEALLAPAIPSVSARAGGIFLPLVKSLCVACGSNVGDGTEHRLGSWLMLTCFQTSVISSSMFLTAMAANPLSANLAFNTIKQTIGWTDWAKAAIVPGLVSLIVVPFLLYLIYPPTVKSSPDAPKLAQEKLDKMGPMSKNELIMAATLFLTVGLWIFGAKLGVDAVTAAILGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVLAFLSNLMGGLTHYGIGSAPIFYGANYVPLAKWWGYGFLISIVNILIWLGVGGAWWKFIGLW

SEQ ID NO: 7768 - protein, 554 aa, Arabidopsis lyrata
MASLALSGSCSLAFPLKSRSLSLPRPPSSSFNLTKPLRSLDSRFSLLKSPLPAASLNRRSSTLVKASSAAASPSPPVAPAPVPWQGAAIKPLIASIATGLILWFVPVPEGVTRNAWQLLAIFLATIVGIITQPLPLGAVALLGLGASVLTKTLTFTAAFSAFGDPIPWLIALAFFFARGFIKTGLGNRVAYQFVRLFGSSSLGLGYSLVFSEALLAPAIPSVSARAGGIFLPLVKSLCVACGSNVGDGTEHRLGSWLMLTCFQTSVISSSMFLTAMAANPLSANLAFNTIKQTIGWTDWAKAAIVPGLVSLIVVPFLLYLIYPPTVKSSPDAPKLAQEKLDKMGPMSKNELIMAATLFLTVGLWIFGAKLSVDAVTAAILGLSVLLVTGVVTWKECLAESVAWDTLTWFAALIAMAGYLNKYGLIEWFSQTVVKFVGGLGLSWQLSFGILVLLYFYTHYFFASGAAHIGAMFTAFLSVSTALGTPPYFAALVLAFLSNLMGGLTHYGIGSAPIFYGANYVPLAKWWGYGFLISIVNILIWLGVGGAWWKFIGLW

SEQ ID NO: 7769 - protein, 556 aa, Cleome gynandra
MASLALSGSLSLAFHTKSRSLALPPLKSSLSLNPPKSLKSLVSKTPNPISLKSPIAKTPFHRRYSVVSASSAASPPSPAAHSPAPWQGAAIKPLMASIATGVILWFVPVPDGVSRSAWQLLAIFLATIVGIITQPLPLGAVALMGLGASVLTKTLTFSAAFSAFGDPIPWLIALAFFFARGFIKTGLGNRIAYQFVRLFGSSSLGLGYSLVFSEALLAPAIPSVSARAGGIFLPLVKSLCVACGSNAGDGTEHKLGAWLMLTCFQTSVISSSMFLTAMAANPLSANLAYNTIKQTIGWTDWAKAAIVPGIVSLIVVPLILYIIYPPTVKSSPDAPKLAKEKLEKMGPMSKNELIMSATLLLTVGLWVFGGKLNVDAVTAAILGLSILLVTGVVTWKECLAEAVAWDTLTWFAALIAMAGYLNKYGLIEWFSQTVVKFVGGLGLSWQLSFGILVLLYFYSHYFFASGAAHIGAMFTAFLSVASALGTPPYFGAMVLAFLSNLMGGLTHYGIGSAPVFYGANYVPLAKWWGYGFLISVVNILIWLGVGGAWWKFIGLW

SEQ ID NO: 7770 - protein, 555 aa, Cleome gynandra
MASLPLSASFSLSFPAKSRSSALPPLKRYLSLNPSKPLRSLDSKISNPVALKFLTKSPVYRRSSVVSASTAASQPSPAVPAPVPWKGAAMKPLIASIATGVILWFVPVPNGVSRSAWQLLAIFLATIVGIITQPLPLGAVALMGLGASVLTKTLTFSAAFSAFGDPIPWLIALAFFFARGFIKTGLGNRIAYQFVRLFGSSSLGLGYSLVFSEALLAPAIPSVSARAGGIFLPLVKSLCVACGSNAGDGTEHRLGAWLMLTCFQTSVISSSMFLTAMAANPLSANLAYNTIKQTIGWTDWAKAAIVPGIASLIVVPLLLYIIYPPTVKSSPDAPKLAKEKLEKMGPMSKNELIMSATLLLTVGLWVFGGKLNVDAVTAAILGLSILLVTGVVTWKECLAEAVAWDTLTWFAALIAMAGYLNKYGLIDWFSQTVVKFVGGLGLSWQLSFGILVLLYFYSHYFFASGAAHIGAMFTAFLSVASALGTPPYFGAMVLAFLSNLMGGLTHYGIGSAPVFYGANYVPLAKWWGYGFVISVVNILIWLGVGGVWWKFIGLW

SEQ ID NO: 7771 - protein, 560 aa, Populus trichocarpa
MASFALTSSSLSFSSLPCLKSRSLSHLRSTSQNPLPPRPNLPKLSAVSPLLPKLSKSSVTSTTRRISNFAVKASSASSAPTSITPASPPWQGAAMKPLLASIAIGVILWFVPVPSGVTKPAWQLLAIFLATIVGIITQPLPLGAVALMGLGASVLTKTLPFSAAFSAFGDPIPWLIALAFFFARGFIKTGLGNRIAYQFVSLFGSSSLGLGYSLVFSEALLAPAIPSVSARAGGIFLPLVKSLCVACGSNVGDGTEHRLGSWLMLTCFQTSVISSSMFLTAMAANPLSATLTFNTIQQTIGWTDWAKAAIVPGLISLIVVPLILYLIYPPTVKSSPDAPKLAREKLEKMGPMTTNEIIMAGTLFLTVGLWIFGGMLNVDAVTAAILGLSVLLITGVVTWKECLAESVAWDTLTWFAALIAMAGYLNKYGLISWFSQTVVKFVGGLGLSWQLSFGILVLLYFYSHYFFASGAAHIGAMFTAFLSVASALGTPPYFGAMVLAFLSNLMGGLTHYGIGSAPIFYGANYVPLAKWWGYGFLISVVNIIIWLGVGGVWWKAIGLW

SEQ ID NO: 7772 - protein, 565 aa, Populus trichocarpa
MASFALTSSSLSFNNSLPCLKSRSLSHLRSTAPHPLPFRPNLPKLSTVSPLLPRFSKSKITTSTRKISNFSVKASASAASPSPAPTSITPASPPWQGAAMKPLLASIATGVILWFVPVPAGVTKPAWQLLAIFLATIVGIITQPLPLGAVALMGLGASVLTKTLTFSAAFSAFGDPIPWLIALAFFFARGFIKTGLGNRIAYQFVSLFGSSSLGLGYSLVFSEALLAPAIPSVSARAGGIFLPLVKSLCVACGSNAGDGTEHKLGSWLMLTCFQTSVISSSMFLTAMAANPLSATLTLNTIKQTIGWTDWAKAAIVPGLVSLIVVPLILYFIYPPTVKTSPDAPKLAREKLEKMGPMSTNEIIMAGTLFLTVGLWIFGGMLNVDAVTAAILGLSVLLVTGVVTWKECLAEAVAWDTLTWFAALIAMAGYLNKYGLISWFSQTVVKFVGGLGLSWQLSFGILVLLYFYSHYFFASGAAHIGAMFTAFLSVASALGTPPLFGAMVLAFFSNLMGGLTHYGIGSAPVFYGANYVPLAKWWGYGFLISVVNIIIWLGVGGVWWKFIGLW

SEQ ID NO: 7773 - protein, 561 aa, Ricinus communis
MASLALTSCSLSFNSLPSLKSRSLSRLRSTPVPNRFPSLPKLSSASTSPFLPKLAKSNPTIFPKQRNSNFTVKSSTSAAPAASAPAPSQPWQGASIKPLLASIATGVIIWFVPVPTGVTKPAWQLLAIFLATIVGIITQPLPLGAVALMGLGASVLTKTLTFSAAFSAFGDPIPWLIALAFFFARGFIKTGLGNRIAYQFVKLFGSSSLGLGYSLVFSEALLAPAIPSVSARAGGIFLPLVKSLCVACGSNAGDGTEHKLGSWLMLTCFQTSVISSAMFLTAMAANPLSANLTFNTIKQTLGWTDWAKAAIVPGLASLIIVPLLLYIIYPPTVKSSPDAPKLAREKLEKMGPMTKNEIIMTGTLLLTVGLWIFGGMLNVDAVTAAILGLSVLLITGVVTWKECLAEAVAWDTLTWFAALIAMAGYLNKYGLISWFSQTVVKFVGGLGLSWQLSFGILVLLYFYSHYFFASGAAHIGAMFTAFLSVASALGTPPYFGAMVLAFLSNLMGGLTHYGIGSAPVFYGANYVPLAQWWGYGFLISVVNIIIWLGIGGVWWKFIGLW

SEQ ID NO: 7774 - protein, 566 aa, Prunus persica
MASLALTTTLSPTLHSLRSHASFPKALLLKPFSVSQTRRNSLKTAALGLGFNKTLISSPKLANLTRDFSPPRRGLSVKAAATTGGSSITPAAKEPWQGAAMKPLLASIATGVILWFVPTPAGVTKNAWQLLAIFLATIVGIITQPLPLGAVALLGLGASVLTKTLTFAAAFSAFGDPIPWLIALAFFFARGFIKTGLGNRIAYQFVSLFGSSSLGLGYSLVFSEALLAPAIPSVSARAGGIFLPLVKSLCVACGSNVGDGTEGKLGSWLMLTCFQTSVISSAMFLTAMAANPLSANLTFNTIKQTIGWTDWAKAAIVPGLVSLIVVPLLLYVIYPPEVKSSPDAPKLARERLEKMGPMSNKEIIMAGTLLLTVGLWIFGGVLNVDAVTAAILGLSVLLVTGVITWKECLAESVAWDTLTWFAALIAMAGYLNKYGLISWFSQTVVKFVGGLGLSWQLSFGILVLLYFYSHYFFASGAAHIGAMFTAFLSVASALGTPPYFGAMVLAFLSNLMGGLTHYGIGSAPVFYGANYVPLGKWWGYGFLVSVVNIIIWLGVGGVWWKFIGLW

SEQ ID NO: 7775 - protein, 552 aa, Artemisia annua
MASLSLTPSVNLAFRNRQSQPLNLTRSNCHVSTHLRSSSFTPLKTTNSPSPLLNGAVKKTVFTVKASSSAAAAPAAPPPVPWQGAAMKPLLASIATGVIIWFIPVPNGVTKNAWQLLSIFLATIVGIITQPLPLGAVALMGLGACVLTKTLTFAAAFSAFGDPIPWLIALAFFFARGFIKTGLGNRIAYQFVKLFGSSSLGLGYSLVFSEALLAPAIPSVSARAGGIFLPLVKSLCVACGSNVGDGTEGKLGSWLMLTCFQTSVISSSMFLTAMAANPLSVNLTFNTIKQTIGWTDWAVAAIVPGLVSLIVVPLILYIIYPPSVKSSPDAPKLAKEKLEKMGPMTKNEIIMGGTLLLTVGLWIFGGMLGIDAVTAAILGLSVLLITGVVTWKECLGEAVAWDTLTWFAALIAMAGYLNKYGLISWFSETVVKFVGGLGLQWQASFGILVLLYFYSHYFFASGAAHIGAMFTAFLSVASALGTPPLFAAMVLAFLSNLMGGLTHYGIGSAPVFYGANYVPLGKWWGYGFIISVVNIIIWLGVGGVWWKFIGLW

SEQ ID NO: 7776 - protein, 552 aa, Helianthus annuus
MASLALTTSVNLGFRSPTTVNHRLSTKQSPAFNLHRSNGPHHLRLPSLKLKSTIRNPNFTVKASAAAVPAKPDAPAPAPVPWQGAAMKPLIASIATGVILWFVPVPAGVSKNAWQLLAIFLATIVGIITQPLPLGAVALLGLGACVLTKTLTFAAAFSAFGDPIPWLIALAFFFARGFIKTGLGNRIAYQFVKLFGSSSLGLGYSLVFSEALLAPAIPSVSARAGGIFLPLVKSLCVACGSNAGDGTEHKLGAWLMLTCFQTSVISSSMFLTAMAANPLSANLTFNTIKQTIGWTDWAVAAIVPGIVSLIVVPLILYVIYPPTVKSSPDAPKLAKEKLEKMGPMTKNEIIMAGTLLLTVGLWIFGGMLNVDAVTAAILGLSVLLITGVVTWKECLGEAVAWDTLTWFAALIAMAGYLNKYGLISWFSQTVVKFVGGLGLQWQASFGILVLLYFYSHYFFASGAAHIGAMFTAFLSVASALGTPPLFGAMVLAFLSNLMGGLTHYGIGSAPVFYGANYVPLAKWWGYGFLISVVNIIIWLGVGGVWWKFIGLW

SEQ ID NO: 7777 - protein, 547 aa, Vitis vinifera
GFRPFSRGQSPPSISFLRSRSTSNGGKQFQQSLLTTTTNPLRVPSPISQTNRVARKLTTVVRASSSTAVTSNPNPPWQGAALKPLAAAIATGVILWFVPQPAGVSRNAWQLLAIFLATIVGIITQPLPLGAVALLGLGASVLTKTLTFAAAFSAFGDPIPWLIALAFFFARGFIKTGLGNRIAYQFVSLFGSSSLGLGYSLVFSEALLAPAIPSVSARAGGIFLPLVKSLCVACGSNVGDGTENRLGSWLMLTCFQTSCISSAMFLTGMAANPLSANLTFNTIKQTLGWTEWAKAAFVPGLVSLIVVPLLLYVIYPPTVKSSPDAPKLAREKLENMGPMSRNEIIMAVTLLLTVGLWIFGGVLNVDAVTAAILGLSVLLVTGVVTWKECLAESVAWDTLTWFAALIAMAGYLNKYGLISWFSQTVVKFVGGLGLSWQLSFSILLLLYFYSHYFFASGAAHIGAMFTAFLSVASALGTPPYFGAMVLAFLSNLMGGLTHYGIGSAPIFYGANYVSLAKWWGYGFLISIVNIVIWLGVGGVWWKAIGLW

SEQ ID NO: 7778 - protein, 559 aa, Gossypium hirsutum
MASVALTSSCPLGYSRIKSLAFSSRSCPNPVFSPPFLPKSTSHNSSFIKQLSLTPVITNNRIQKRHSKLTVKAAASTPAAVTPPSQQPWQGAALKPLIASIATGVILWFLPVPSGVSRNAWQLLSIFLATIVGIITQPLPLGAVALLGLGASVLTKTLTFSAAFSAFGDPIPWLIALAFFFARGFIKTGLGNRIAYQFVSLFGSSSLGLGYSLVFSEALLAPAIPSVSARAGGIFLPLVKSLCAACGSNVGDGTENRLGSWLMLTCFQTSVISSSMFLTAMAANPLSANLAFNTIKQQIGWMDWAKAAFVPGLVSLLVVPLILYVIYPPTVKTSPDAPKLAREKLEKMGPMSKNEIIMAGTLFLTVGLWIFGGVLNVDAVTAAILGLSVLLVTGVVTWKECLAESVAWDTLTWFAALIAMAGYLNKYGLISWFSQTVVKVVGGLGLSWQMSFGILVLLYFYSHYFFASGAAHIGAMFTAFLSVASALGTPSYLGALVLSFLSNLMGGITHYGIGSAPVFYGAGYVPLAKWWGYGFLISVVNIIIWLGVGGIWWKAIGLW

SEQ ID NO: 7779 - protein, 573 aa, Manihot esculenta
MASLALTSSSSCSLAFNCLPSLKSRSLSHIRSTPNRVPFLPKLTANSRFPLSHSFLPKFSKSNVATATAISQKRRNLNLTVKASVSASSPASASASSSSTQPWQGAAIKPLLASIATGVILWFVPVPSGVSRPAWQLLAIFLATIVGIITQPLPLGAVALMGLGASVLTKTLTFSAAFSAFGDPIPWLIALAFFFARGFIKTGLGNRIAYQFVSLFGSSSLGLGYSLVFSEALLAPAIPSVSARAGGIFLPLVKSLCVACGSNVGDGTENKLGSWLMLTCFQTSVISSSMFLTAMAANPLSANLTLSTIKQTIGWTDWAKAAFVPGLVSLLVVPLLLYIIYPPTVKTSPDAPKLAREKLEKMGPMTKNEIIMTGTLLLTVGLWIFGSKLNVDAVTAAILGLSVLLITGVVTWKECLAESVAWDTLTWFAALIAMAGYLNKYGLISWFSQTVVKFVGGLGLSWQLSFGILVLLYFYSHYFFASGAAHIGAMFTAFLSVASALGTPPYFGAMVLSFLSNLMGGLTHYGIGSAPVFYGANYVPLAKWWGYGFLISVVNIIIWLGVGGVWWKAIGLW

SEQ ID NO: 7780 - protein, 565 aa, Aquilegia formosa
MASLALTCSPSSCNLGFRSLSSCRSRSIKPSSSSLNLQSTTRSKISLNQNHLFSFSNPLRNDIVLKSTTSSLPNRRSLIVQASSTSNPVVPAEPWQGASMKPLLASIATGVILWFVPVPAGVTKNAWQLLAIFLATIVGIITQPLPLGAVALMGLGAAVLTKTLTFAAAFSAFGDPIPWLIALAFFFARGFIKTGLGNRIAYQFVSLFGSSSLGLGYSLVFSEALLAPAIPSVSARAGGIFLPLVKSLCVACGSNVGDGTERKLGSWLMLTCFQTSVISSSMFLTAMAANPLSANLTMNTIQQNISWTLWAKAAFVPGLVSLIVVPFLLYIIYPPTVKSSPDAPKLAKENLAKMGPMTKNETIMAVTLLLTVGLWIFGGALKVDAVTAAILGLSVLLTTGVVTWKECLGEAVAWDTLTWFAALIAMAGYLNKYGLISWFSETVVKVVGGLGLSWQLSFGILVLLYFYSHYFFASGAAHIGAMFTAFLSVASALGTPPLFGAMVLAFLSNLMGGLTHYGIGSAPVFYGANYVPLAQWWGYGFLISVVNILIWLGVGGAWWKFIGLW

SEQ ID NO: 7781 - protein, 570 aa, Manihot esculenta
MTSLALTMSSSCSLAFNSRPSFKSPSLSHFRSSATRLPSFPKLTANIRFSPAISYLPKFSKSDAVTATEVFQKRRSFSLTVKASVAAASPASSTPPSQPWHGAAIKPLLASIATGVILWFIPVPSGVSRPAWQLLAIFLATIVGIITQPLPLGAVALMGLGASVLTKTLTFSAAFSAFGDPIPWLIALAFFFARGFIKTGLGNRIAYQFVSLFGSSSLGLGYSLVFSEALLAPAIPSVSARAGGIFLPLVKSLCVACGSNAGDGTEHKLGSWLMLTCFQTSVISSSMFLTAMAANPLSANLTFNTIKQTIGWTDWATAAIVPGLVSLFVVPLLLYIIYPPTVKSSPDAPKLAREKLEKMGPMTKNEIIMAGTLLLTVGLWIFGSKLNVDAVTAAILGLSMLLITGVVTWKECLSEAVAWDTLTWFAALIAMAGYLNKYGLISWFSQTVVKFVGGLGLSWQLSFGILVLLYFYSHYFFASGAAHIGAMFTAFLSVASALGTPPYFGAMVLSFLSNLMGGLTHYGIGSAPVFYGANYVPLAKWWGYGFLMSVVNIIIWLGIGGIWWKAIGLW

SEQ ID NO: 7782 - protein, 563 aa, Antirrhinum majus
  misc_feature (54)..(55): Xaa can be any naturally occurring amino acid
  misc_feature (60)..(60): Xaa can be any naturally occurring amino acid
  misc_feature (64)..(64): Xaa can be any naturally occurring amino acid
  misc_feature (186)..(186): Xaa can be any naturally occurring amino acid
MASLALTSSINLRFRPLSAPKTRTPLKSLHPTPRFKSLIKNCASKSSNSTPPNXXIDQTXFVNXKPSFQNRSLITIPSASAAPAVVPPPPQPWQGAAIKPLLASIATGVILWFIPAPEGVSRIAWQLLSIFLATIVGIITQPLPLGAVALMGLGAAVLTKTLTFAAAFSAFGDPIPWLIALAFFFXRGFIKTGLGNRIAYQFVSLFGSSSLGLGYSLVFSEALLAPAIPSVSARAGGIFLPLVKSLCVACGSNVGDGTEHKLGSWLMLTCFQTSVISSSMFLTAMAANPLAANLTANTINMSIGWMDWAKAAIVPGLVSLIVVPMLLYIIYPPTVKSSPDAPKLAKDKLEKMGPMSKNEIIMAGTLLLTVGLWIFGSTLNVDAVTAAILGLSVLLITGVVTWKECLAESVAWDTLTWFAALIAMAGYLNKYGLISWFSQTVVKFVGGLGLSWQLSFGILVLLYFYSHYFFASGAAHIGAMFTAFLSVATALGTPPYLGALVLSFLSNLMGGITHYGIGSAPVFYGAGYVPLAKWWGYGFLISVVNLIIWLGVGGLWWKAIGLY

SEQ ID NO: 7783 - protein, 567 aa, Mimulus guttatus
MASLALTSSLNLRCRPLSTPNFRPLAAPKSLRLTPRFKSPIKSSVTNSNDPLGEDQFQFQFTEPKPSVFLPAPKRAATKVASASSSPAVSPPPPQPWQGAAIKPLVASIAVGVILWFIPAPNGVSRIAWQLLSIFLATIVGIITQPLPLGAVALMGLGACVLTKTLTFAAAFSAFGDPIPWLIALAFFFARGFIKTGLGNRIAYQFVSLFGSSSLGLGYSLVFSEALLAPAIPSVSARAGGIFLPLVKSLCVACGSNVGDGTEEKLGSWLMLTCFQTSVISSSMFLTAMAANPLAANLTASTINMTIGWMDWAKAAIVPGLVSLIVVPLLLYIIYPPTVKSSPDAPKLAKEKLAKMGPMSKNEIIMAGTLLLTVGLWIFGSALSVDAVTAAILGLSVLLITGVVTWKECLAESVAWDTLTWFAALIAMAGYLNKYGLITWFSQSVVKFVGGLGLSWQLSFGILVLLYFYSHYFFASGAAHIGAMFTAFLSVASALGTPPYLGAVVLAFLSNLMGGITHYGIGSAPVFYGAGYVPLAKWWGYGFLISIVNLVIWLGVGGAWWKFLGLW

SEQ ID NO: 7784 - protein, 562 aa, Citrus sinensis
MASLALTPSSCSLGLHSLTSRSLKLTPRSTSTRLHSSNSNSNSLTQTNNLTFRNQYFLTNPSLKFKRLTVQASASAGAAVAPAPEQKPQQPWQGAALKPLIASIATGLILWFVPVPSGVSKNAWQLLAIFLATIVGIIAQPLPLGAVALLGLGASVLTKTLTFSAAFSAFGDPIPWLIALAFFFARGFIKTGLGNRIAYQFVKLFGSSSLGLGYSLVFSEALLAPAIPSVSARAGGIFLPIVKSLCLACGSNTGDGTEHKLGSWLMLTCFQTSVISSSMFLTAMAANPLSATLTLNTINQPIGWMDWAKAAIVPGLVSLIVVPLLLYIIYPPTVKSSPDAPKLAHEKLEKMGPMSTNEKIMAGTLLLTVGLWVFGGRLNVDPVTAAILGLSILLVTGVVTWKECLAESVAWDTLTWFAALIAMAGYLNKYGLITWFSQTVVKFVGGLGLSWQLSFGILILLYFYSHYFFASGAAHIGAMFTAFLSVASALGCPPYFVAMVLAFFSNLMGGLTHYGIGSAPVFYGANYVPLAKWWGYGFIVSIVNIIIWLGVGGVWWKFIGLW

SEQ ID NO: 7785 - protein, 293 aa, Brassica napus
MPRYDDRYGNTRLYVGHLSSRTRTRDLERLFNRYGRVRDVDMKRDYAFVEFSDPRDADDARHYLDGRDFDGSRITVEFSRGAPRGSRDYDSRGPPPGAGRCFNCGVDGHWARDCTAGDWKNKCYRCGERGHIERNCKNSPKKLRRSGSYSRSPVRSRSPRRRRSPSRSRSLSRSRSYSRSRSPVKRRERSEEERSRSPKRMEDSLSPRGRDRSPIMDDEGSPRIIDGSPPPSPKLEKPAGSDHDGGSSPQDNGNGRNTVASPVVGRDSPREDRSPVDDDYEANRASPRGSESP

SEQ ID NO: 7786 - protein, 289 aa, Raphanus sativus
MPRYDDRYGNTRLYVGHLSSRTRTRDLERLFNRYGRVRDVDMKRDYAFVEFSDPRDADDARHYLDGRDFDGSRITVEFSRGAPRGSRDYDSRGPPPGAGRCFNCGVDGHWARDCTAGDWKNKCYRCGERGHIERNCKNSPKKLRRSGSYSRSPVRSRSPPRRRRSPSRSRSLSRSYSRSRSPVKRRERSVEERSRSPKRMEDSLSPRGRDRSPIMDDEGSPRIIDGSPPPSPKLEKQAGSDHDGGVSPQNNGDGSNTVGRGADSPREDRSPVDDDYEANRASPRGSESP

SEQ ID NO: 7787 - protein, 292 aa, Arabidopsis lyrata
MPRYDDRYGNTRLYVGRLSSRTRTRDLERLFSRYGRVRDVDMKRDYAFVEFGDPRDADDARHYLDGRDFDGSRITVEFSRGAPRGSRDYDSRGPPPGAGRCFNCGVDGHWARDCTAGDWKNKCYRCGERGHIERNCKNSPKKLRRSGSYSRSPVRSRSPRRRRIPSQSLSRSRSYSRSRSPVRRRERSVEERSRSPKRMDDSLSPRVRDRSPVLDDEGSPKIIDGSPPPSPKLQKEDGSDRDGGSPQDNGNGRNSVVSPVVGAGGDSLKEDQSPIDDDYEPNRASPRGSESP

SEQ ID NO: 7788 - protein, 290 aa, Arabidopsis thaliana
MPRYDDRYGNTRLYVGRLSSRTRTRDLERLFSRYGRVRDVDMKRDYAFVEFGDPRDADDARHYLDGRDFDGSRITVEFSRGAPRGSRDFDSRGPPPGAGRCFNCGVDGHWARDCTAGDWKNKCYRCGERGHIERNCKNSPKKLRRSGSYSRSPVRSRSPRRRRSPSRSLSRSRSYSRSRSPVRRRERSVEERSRSPKRMDDSLSPRARDRSPVLDDEGSPKIIDGSPPPSPKLQKEVGSDRDGGSPQDNGRNSVVSPVVGAGGDSSKEDRSPVDDDYEPNRTSPRGSESP

SEQ ID NO: 7789 - protein, 252 aa, Brassica oleracea
MKRDYAFVEFSDPRDADDARHYLDGRDFDGSRITVEFSRGAPRGSRDYDSRGPPPGAGRCFNCGVDGHWARDCTAGDWKNKCYRCGERGHIERNCKNSPKKLRRSGSYSRSPVRSRSPRRRRSPSRSRSLSRSRSYSRSRSPVKRRERSEEERSRSPKRMEDSLSPRGRDRSPIMDDEGSPRIIDGSPPPSPKLEKPAGSDHDGGSSPQDNGNGINTVASPVVGRDSPREDRSPVDDDYEANRASPRGSESP

SEQ ID NO: 7790 - protein, 240 aa, Brassica juncea
EFSDPRDADDARHYLDGRDFDGSRITVEFSRGAPRGSRDYDSRGPPPGSGRCFNCGVDGHWARDCTAGDWKNKCYRCGERGHIERNCKNSPKKLRRSGSYSRSPVRSRSPRRRRSPSRSRSLSRSRSYSRSRSPVKRRERSVEERSRSPKRMDDSLSPRGRDRSPIMDDEGSPRIIDGSPPPSPKLEKQDHDGGSPQDNGNDRKTDASPVVGRDSPREDRSPVDDDYEANRASPRGSESP

SEQ ID NO: 7791 - protein, 386 aa, Cajanus cajan
MELSTMFCLCASFLFIVLFRTLIKSKRRGDLPLPPGSMGWPYIGETFQMYSQDPNVFFTSKIKRYGSMFKSHILGCPCVMISSPEAAKFVLNKAQLFKPTFPASKERMLGKQAIFFHQGEYHANLRRLVLRTFMPEAIRNIVPDIESIAQACLKSWEGRLITTFLEMKTFTFNVALLSIFGKEEILYREALKRCYYTLEQGYNSMPINVPGTLFHKAMKARKELAQIVAQIISSRRQRKQDYKDLLGSFMGEKAGLTDEQIADNVIGVIFAARDTTASVLTWIVKYLGENPSVLEAVTEEQECILKSKEESGEDKGLNWEDAKKMPITSRVIQETLRVASILSFTFREAIEDVEYQGYLIPKGWKVLPLFRNIHHSPENFKEPEKV

SEQ ID NO: 7792 - protein, 464 aa, Phaseolus coccineus
MELSTILCLGASFLFIFLFRTLIKQFLSKRPHFPLPPGTMGWPYIGETFQMYSQDPNVFFASKIKRYGSMFKSHILGCPCVMISSPEAAKFVLNKAQLFKPTFPASKERMLGKQAIFFHQGEYHANLRRLVLRTFMPEAIKNIVPDIESIAQDSLKSWEGRLITTFLEMKTFTFNVALLSIFGKEEILYRDALKRCYYTLEQGYNSMPINVPGTLFHKAMKARKELAQIVAQIISSRRQRKQDYKDLLGSFMGEKAGLTDEQIADNVIGVIFAARDTTASVLTWIVKYLGENPSVLEAVTEEQECILKTKEESGEDKGLNWEDTKKMPITSRVIQETLRVASILSFTFREAVEDVEYQGYLIPKGWKVLPLFRNIHHSPDNFKEPEKFDPSRFEAAPKPNTFMPFGSGIHACPGNELAKLEILVLLHHLTTKFRWSVVGAKNGIQYGPFALPQNGLPITLYPKK

SEQ ID NO: 7793 - protein, 467 aa, Glycine max
MELSTMFCLCASFLFIVLFRALIKPYYVSKRRDLPLPPGSMGWPYIGETFQMYSQDPNVFFASKIKRFGSMFKSHILGCPCVMISSPEAAKFVLNKAQLFKPTFPASKERMLGKQAIFFHQGEYHANLRRLVLRTFMPEAIKNIVPDIESIAQDCLKSWEGRLITTFLEMKTFTFNVALLSIFGKEEILYRDALKRCYYTLEQGYNSMPINVPGTLFHKAMKARKELAQIVAQIISSRRQRKQDFHKDLLGSFMDEKSGLTDEQIADNVIGVIFAARDTTASVLTWIVKYLGENPSVLEAVTEEQECILKSKEESGEDKGLNWEDAKKMPITSRVIQETLRVASILSFTFREAVEDVEYQGYLIPKGWKVLPLFRNIHHSPDNFKEPEKFDPSRFEAAPKPNTFMPFGSGIHMCPGNELAKLEILVLLHHLTTKYRWSVVGAKNGIQYGPFALPQNGLPITLFPKSK

SEQ ID NO: 7794 - protein, 468 aa, Glycine max
MELSTMFFLCASLLFIVLFFRTLIKPYYVSKRRDLPLPPGSMGWPYIGETFQMYSQDPNVFFASKIKRFGSMFKSHILGCPCVMISSPEAAKFVLNKAQLFKPTFPASKERMLGKQAIFFHQGEYHANLRRLVLRTFMPEAIKNIVPDIESIAQDCLKSWEGRLITTFLEMKTFTFNVALLSIFGKEEILYRDALKRCYYTLEQGYNSMPINVPGTLFHKAMKARKELAQIVAQIIWSRRQRKMIDYKDLLGSFMDEKSGLTDDQIADNVIGVIFAARDTTASVLTWIVKYLGENPSVLEAVNEEQECILKSKEERGEDKGLNWEDAKKMPITSRVIQETLRVASILSFTFREAVEDVEYQGYLIPKGWKVLPLFRNIHHSPDNFKEPEKFDPSRFEAAPKPNTFMPFGSGIHMCPGNELAKLEILVLLHHLTTKYRWSVVGAKNGIQYGPFALPQNGLPITLFPKNK

SEQ ID NO: 7795 - protein, 461 aa, Lotus japonicus
MELSINFTLFVSFLLIVLFRLLIKPFISKKHNLPLPPGSMGYPYIGETFQMYSQDPNVFFASKIKRYGSMFKSHILGCPCVMISSPEAAKFVLNKAQLFKPTFPASKERMLGKQAIFFHQGEYHANLRRLVLRAFMPEAVRSIIPNIESIAKDCLESWEGRSITTFLEMKTFTFTVALLSIFGKDEILYRERLKQCYYTLEQGYNSMPINLPGTLFHKAMKARKELAQIVAQIISSRRQSKQEYKDLLGSFMGEKAGLTDEQIADNVIGVIFAARDTTASVLTWIVKYLGENPSVLQAVTEEQENILKSKEEDKGLNWEDAKNMPITSRVIQETLRVASILSFTFREAVEDVEYQGYLIPKGWKVLPLFRNIHHSPENFKDPAKFDPSRFEVAPKPNTFMPFGSGIHACPGNELAKLEILVLLHHLTTKYRWSVAGAKSGIQYGPFALPQNGLPITLYSKK

SEQ ID NO: 7796 - protein, 466 aa, Medicago truncatula
MEITTLFFYFASFLFIVLFKSLIKNFLFPSNGKQLPLPPGSMGYPYIGETFQMYSQDPSLFFANKIKRYGAMFKSHILGCPCVMISSPEAAKFVLNKSQLFKPTFPASKERMLGKQAIFFHQGNYHANLRRLVLRSFMPEAIKSIVPNIESIAQTCLKSWDGNLITTYLEMKTFTFNVALLSIFGKDEILYREDLKRCYYTLEKGYNSMPINLPGTLFHKAMKARKELAQILEQIISTRRCKKQVYNDLLASFMDEKAGLSDEQISDNIIGVIFAARDTTASVLTWIVKYLGENPSVLESVTEEQMSIIKGKQENGEEIGLNWEDTKNMPITSRVIQETLRVASILSFTFREATEDVEYQGYLIPKGWKVLPLFRNIHHSPENFKEPEKFDPSRFEVAPKPNTFMPFGNGVHACPGNELAKLEILVLVHHLTTKYRWSVVGEKNGIQYGPFALPQNGLPINLYSKK

SEQ ID NO: 7797 - protein, 329 aa, Cajanus cajan
MPEAIKDIVSSIESIAQSCLKSWEGKMITTFLEMKNFTFNVALLSIFGKDETLYRESLKRCYYTLERGYNSMPINLPGTLFHKAMKARKELAQILAQIILTRRNMKQDYNDLLGSFMSEKSGLTDEQIADNIIGIIFAARDTTATVLTWIVKYLGENPSVLEAVTEEQESILRGKKESGEEMGLNWSDTKNMPVTSRVIQETLRIASILSFTFREAVEDVEFQGYLIPKGWKVLPLFRNIHHSPDNFKEPEKFDPSRFEVAPKPNTFMPFGNGTHACPGNELAKLEILVLLHHLTTKYRWSAIGAKNGIQYGPFALPQNGLPITLYSKK

SEQ ID NO: 7798 - protein, 465 aa, Glycine max
MELSTMLFLFVSFLTILFSKSLIKFFFSSKGRQLPLPPGTMGWPYIGETFQMYSQDPNVFFATKIKRYASIFKSHILGYPCVMMSDPEAAKFVLNKAQLFKPTFPASKERMLGKQAIFFHQGAYHANLRRLVLRTFRPEVIKDKVSYIESIAQSCLKSWEGKMITTFLEMKTFTFNVALLSIFGKDENLYGEDLKRCYYTLERGYNSMPINLPGTLFHKAMKARKELAQILAQIISTRRNMKQDHNDLLGSFMSEEAGLSDEQIADNIIGLIFAARDTTATVLTWIVKYLGENTSVLEAVTEEQESILRAKEESGEEMGLNWSDTKNMPVTSRVIQETLRIASILSFTFREAVEDVEFQGYLIPKGWKVLPLFRNIHHSPDNFKEPEKFDPSRFEVALKPNTFMPFGNGTHACPGNELAKLEILVFLHHLTTEYRWSLIGAKNGVQYGPFALPQNGLRITLYPKK

SEQ ID NO: 7799 - protein, 468 aa, Glycine max
MELSTIMLCLFASFLSILLFKSLIKPFFFSSKGRQLPLPPGTMGLPYIGETFQMYSQDPNVFFATKIKRYGSMFKSHILGYPCVMISDPEAAKFVLNKAQLFKPTFPASKERMLGKQAIFFHQGAYHANLRKLVLRTFMPEAIKDKVSNIESIALSCLKSWEGKMITTFLEMKTFTFNVALLSIFGKDENLYGEALKRCYCTLERGYNSMPINLPGTLFHKAMKARKELAQILAQIISTRRNMKQDHNNNDLLGSFMSEKAGLTDEQIADNIIGAIFAARDTTATVLTWIVKYLGENPSVLEAVTEEQESLLRGKEESGEKMGLNWSDTKNMPVTSRVIQETLRIASILSFTFREAVEDVEFQGYLIPKRWKVLPLFRNIHHSPDNFKEPEKFDPSRFEVAPKPNTFMPFGNGTRACPGNELANLEILVFLHHLTTKYRWSLMGAKNGIQYGPFAIPQNGLPITLYPK

SEQ ID NO: 7800 - protein, 504 aa, Vigna unguiculata
  misc_feature (8)..(8): Xaa can be any naturally occurring amino acid
  misc_feature (22)..(22): Xaa can be any naturally occurring amino acid
DNLASFSXRNTPFSFYSMSLSXTIKLHLASSSSSHLTLNTHHHHAKKVKTFETFCYNTRIRPNPIYSTNPLIIPACRIRQRVQCGAMVKSSLIEPDGGALVDLVVPESVRSTKIVEAETLPKVQLTRIDLEWVHVVGEGWASPLRGFMREDEYLQSLHFNSLRVKDGSFVNMSLPIVLAIDDDTKGRIGSSTHVALLGPDGDFVAILRSVEIYKHNKEERIARTWGTTAPGLPYVEEVITRAGNWLIGGDLEVLKPIKYNDGLDDYRLSPKQLREEFDKREADAVFAFQLRNPVHNGHALLMNDTRKRLLEMGYKNPILLLHPLGGFTKADDVPLDVRMEQHSKVLEDGVLDPETTIVAIFPSPMHYAGPTEVQWHAKARINAGANFYIVGRDPAGMGHPTEKRDLYDPDHGKKVLSMAPGLEKLNILPFRVAAYDNKVNKMAFFDPTRAKDFLFISGTKMRAFAKSGENPPDGFMCPSGWKVLVKYYESMQAEEPSEQPVLST

SEQ ID NO: 7801 - protein, 481 aa, Arachis hypogaea
MSLSIKLHVTTSHLNYLNHHAKTNTNTSTSNIRTKPIYTSNPLIITTSRSRKMSLGCYGAPFIKSSLIEPDGGALVDLVVPESQRGPKILEAEALPKVKLTKIDIEWVHVISEGWASPLRGFMREDEYLQSLHFNALRLKGNGSLVNMSLPIVLAIDDQTKEKIGNSSNVGLLGPSGDCIAILRSIEIYKHNKEERIARTWGTIAAGLPYVEEAITPAGNWLLGGDLEVLKPIKYNDGLDNYRLSPKQLREEFDRREADAVFAFQLRNPVHNGHALLMNDTRKGLLEMGYKNPILLLHPLGGFTKADDVPLSVRMEQHSKVLEDGVLDPETTIVAIFPSPMHYAGPTEVQWHAKARINAGANFYIVGRDPAGMGHPTEKRDLYDPDHGKKVLSMAPGLEKLNILPFRVAAYDTSENKMAFFDPSRAKDFLFISGTKMRAYAKSGENPPDGFMCPNGWKVLLKYYESLQTEESPQQPAVLSA

SEQ ID NO: 7802 - protein, 486 aa, Medicago truncatula
MSLTIKLQLVSHLNINHNNNHANKLIKIKNNTFGNTLNFLPKPTFGNNSLTVTKKSNNKVKRRMQGNFMIKSSLIEPDGGVLVDLMVPENERESKVLEAKSLPNVKLTKVDYEWVHVIGEGWASPLKGFMRENEYLQSLHFNSLRLNDGSFVNMSLPIVLSIDDETKERIGSSSNVGLIGPDGDIVGILRSIEIYKHNKEERIARTWGTTAPGLPYVEEVIAPAGNWLIGGDLEVLKPIKYNDGLDNYRLSPKQLREEFDRRKADAVFAFQLRNPVHNGHALLMNDTRQRLLDMGYKNPILLLHPLGGFTKVDDVPLDVRMEQHSKVLEDGVLDPETTIVSIFPSPMHYAGPTEVQWHAKARINAGANFYIVGRDPAGMGHPTEKRDLYDPDHGKKVLSMAPGLEKLNILPFRVAAYDTKVNKMAFFDPSRAKDFLFISGTKMRSYAKSGENPPDGFMCPSGWKVLVNYYESLQTEEASQQPVLSS

SEQ ID NO: 7803 - protein, 481 aa, Gossypium hirsutum
MSLTIKSHFASRTYLSFTTKPSRFTGYNTKIRPNSIYHFNPLRLTYYQPKKMQAPVQYSPAPLIKSSLIEPDGGALVDLVVPEGERGAKTIEAESLPKVRLTKIDVEWVHVISEGWANPLKGFMREDEYLQSLHFSSLRLKDGYVVNMSLPIVLAIDDETKERIGSSSHVGLVGPDGDLIAILRSIEIYKHNKEERIARTWGTTAPGLPYVEEVITPAGNWLIGGDLEVLKPIKYNDGLDHYRLSPKQLRKEFDRRNADAVFAFQLRNPVHNGHALLMNDTRRRLLEMGFKNPILLLHPLGGFTKADDVPLDVRMEQHSKVLEDGVLDPETTIVAIFPSPMHYAGPTEVQWHAKARINAGANFYIVGRDPAGMGHPTEKRDLYDPDHGKKVLSMAPGLEKLNILPFRVAAYDIVAKKMAFFDPSRAKDFLFISGTKMRTYARTGENPPDGFMCPGGWEVLVKYYESLQAEEATQQPAAVSS

SEQ ID NO: 7804 - protein, 481 aa, Gossypium hirsutum
  misc_feature (145)..(145): Xaa can be any naturally occurring amino acid
  misc_feature (216)..(216): Xaa can be any naturally occurring amino acid
MSLTIKSHFASRTYLSFTTKPSRFTGYNTKIRPNSIYHFNPLRLTYYQPKKMQAPVQYSPAPLIKSSLIEPDGGALVDLVVPEGERGAKTIEAESLPKVRLTKIDVEWVHVISEGWANPLKGFMREDEYLQSLHFSSLRLKDGYXVNMSLPIVLAIDDETKERIGSSSHVGLVGPDGDLIAILRSIEIYKHNKEERIARTWGTTAPGLPYVEEVIXPAGNCLIGGDLEVLKPVKYNDGLDHYRLSPKQLRKEFDRRNADAVFAFQLRNPVHNGHALLMNDTRRRLLEMGFKNPILLLHPLGGFTKADDVPLDVRMEQHSKVLEDGVLDPETTIVAIFPSPMHYAGPTEVQWHAKARINAGANFYIVGRDPAGMGHPTEKRDLYDPDHGKKVLSMAPGLEKLNILPFRVAAYDIVAKKMAFFDPSRAKDFLFISGTKMRTYARTGENPPDGFMCPGGWEVLVKYYESLQAEEATQQPAAVSS

SEQ ID NO: 7805 - protein, 478 aa, Citrus sinensis
  misc_feature (333)..(333): Xaa can be any naturally occurring amino acid
MSLTIKAHIAAHFNLNLRTAKQTKLTDYNVKIRPKPIYHSNQLIAFQPKMSAAVKSASSAIKSSLIEPDGGVLVDLVVPESERGLRTTEAESMPRVKLTKIDLEWVHVISEGWASPLRGFMRENEYLQSLHFNCLRMKDGSIVNMSLPIVLAIDDETKERIGSSTNVALLGPTGDLIGILRSIEIYKHNKEERIARTWGTTAAGLPYVEEVITPAGNWLVGGDLEVLKPIKYNDGLDHYRLSPQQLRKEFDNRQADAIFAFQLRNPIHNGHALLMNDTRRRLLEMGYKNPILLLHPLGGFTKADDVPLDVRMEQHSKVLEDGVLDPETTIVSXFPSPMHYAGPTEVQWHAKARINAGANFYIVGRDPAGMGHPTEKRDLYDPDHGKKVLSMALGLEKLNILPFRVAAYDTVEKKMAFFDPSRAKDFLFISGTKMRTFARSGENPPDGFMCPGGWKVLVQYYESLQAEEATQQPAILTS

SEQ ID NO: 7806 - protein, 656 aa, Solanum phureja
MAHDSDLPCDGDGVCMACKVKPSENESLTCKTCATPWHVSCLSAPPDSMGDAVNWECPDCSMPPAADVVPVKQNAAASSSSGGRGDLIAAIRVIESDSTLTEQEKAQKRQDLMSGNSKDEGATVEGVNQDKDVLNILDSSLNCSMCMQLPERPVTTPCGHNFCLKCFQKWVGQRKSTCANCRTPIPAKMASQPRINSALVIAIRMARMMRSGASSGSSKVSHFVHNQNRPDKAFTTERAKKTGKANACSGKIFVTIPGDHFGPISADNDPERNVGVMVGETWEDRFECRQWGAHFPHVAGIAGQSDYGAQSVALSGGYEDDEDHGEWFLYTGSGGRDLSGNKRTNKLQSFDQKFEKLNEALRVSCLKGYPVRVVRSHKEKCSSYAPDKGVRYDGVYRIEKCWRKPGKQGFKVCRYLFVRCDNDPAPWTSDEHGDRPRALPAIKELKGATDMTERKGAPAWDYDEEKSCWMWKKAPPPSRKPVQCENEDGTKMRQVRPKRLTMSVKQRLLKEFTCHLCREVMNHPLTTPCAHNFCKACLDGAFAGQSFTRQRTCEGRRTLRAQKNIMKCPSCPTDISDFLQSPQINRELMNVIESLKRQIEEENAALSVDVDDGSLDGNNEIIADEAVETDKSVEDDKEGAQPVNETETKQTHKRKR

SEQ ID NO: 7807 - protein, 362 aa, Raphanus sativus
  misc_feature (339)..(339): Xaa can be any naturally occurring amino acid
MEVEFKAMLDDLDVLEKSLSDPAPIHKLRSHVENLAALSKCNPHRRSKVKELSSEVVDSNPYSRLMALQRMGIVENYERIREFSVAIVGIGGVGSVAAEMLTRCGIGRLLLYDYDTVELANMNRLFFRPDQVGMTKTDAAVQTLAEINPDVVLESFTMNITTVQGFETFTSSLKNKSFCPSKEGSGVDLVLSCVDNYEARMAVNQACNELRQTWMESGVSEDAVSGHIQLLVPGETACFACAPPLVVASGIDERTLKREGVCAASLPTTMGVVAGLLVQNSLKFLLNFGEVSPYLGYNSLKDFFPTMQMRPNPQCSNVACMERQKEYMLAKPARDAAAXAKMEADALTAIDDGPLHDDMSGT

SEQ ID NO: 7808 - protein, 429 aa, Brassica napus
MEVELKALLDDLNVLEKSLSDPAPIQKLRSHVENLAALSKCNPHRRSKVKELSSEVVDSNPYSRLMALQRMGIVENYERIREFSVAIVGIGGVGSVAAEMLTRCGIGRLLLYDYDTVELANMNRLFFRPDQVGMTKTDAAVQTLAEINPDVVLESFTMNITTVQGFETFTSSLKNKSFCPTKEGSGVDLVLSCVDNYEARMAVNQACNELNQTWMESGVSEDAVSGHIQLLVPGETACFACAPPLVVASGIDERTLKREGVCAASLPTTMGVVAGLLVQNSLKFLLNFGEVSPYLGYNSLKDFFPTMQMRPNPQCSNAACLERQKEYMLAKPARDAAAKAKMEAEAATAVDDGPLHDDNEWNISVVDDENEKDTTKASSSSGALPEGLTRELPEADEYEKAIAIGSGETDEEEDDLEDLKKQLEALNAA

SEQ ID NO: 7809 - protein, 429 aa, Brassica napus
MEVEFKAMLDDLDALEKSLSDPAPIHKLRSHVENLAALSKCSPHRRSKVKELSSEVVDSNPYSRLMALQRMGIVENYERIREFSVAIVGIGGVGSVAAEMLTRCGIGRLLLYDYDTVELANMNRLFFRPDQVGMTKTDAAVQTLAEINPDVVLESFTMNITTVQGFETFTSSLKNKSFCPNKEGSGVDLVLSCVDNYEARMAVNQACNELNQTWMESGVSEDAVSGHIQLLVPGETACFACAPPLVVASGIDERTLKREGVCAASLPTTMGVVAGLLVQNSLKFLLNFGEVSPYLGYNSLKDFFPTMQMRPNPQCSNAACLERQKEYMLAKPARDAAAKAKMEAEAATAVDDGPLHDDNEWNISVVDDENEKDTTKASSSSGALPEGLTRELPEADEYEKAIAIGSGETDEEEDDLEDLKKQLEALNAA

SEQ ID NO: 7810 - protein, 240 aa, Brassica napus
MEVELKALLDDLNVLEKSLSDPAPIQKLRSHVENLAALSKCNPHRRSKVKELSSEVVDSNPYSRLMALQRMGIVENYERIREFSVAIVGIGGVGSVAAEMLTRCGIGRLLLYDYDTVELANMNRLFFRPDQVGMTKTDAAVQTLAEINPDVVLESFTMNITTVQGFETFTSSLKNKSFCPTKEGCGVDLVLSCVDNYEARMAVNQACNELSQTWMESGVSEDAVSGHIQLLVPGETACFA

SEQ ID NO: 7811 - protein, 425 aa, Carica papaya
MEAELNGLLHDLDSLKQSLHDPSSLASLDKLRSRVEHVTNLAKSAAVRRSKVKDMSAEVVDSNPYSRLMALQRMGIVENYERIREFSVAIVGIGGVGSVAAEMLTRCGIGRLLLYDYDKVELANMNRLFFRPDQVGMTKTDAAVQTLSDINPDVVLESYTLNITTVQGFETFMSSLRNKSFRPSKEGSGVDLVLSCVDNYEARMAVNQACNELNQTWMESGVSEDAVSGHIQLLVPGETACFACAPPLVVASGVDERTLKREGVCAASLPTTMGVVAGLLVQNTLKFLLSFGYVSPYLGYNSLKDYFPTMQMKPNPQCSNVACLQRQNDYILAKPARDAAAKAKMQAEASTSVEGPLHFDNEWNISVVDDSEVDTTGATSSDNLPEGLTRELPSADEYQKLPVPAEIASIDDLDDLRRQLEALNA

SEQ ID NO: 7812 - protein, 428 aa, Ricinus communis
MEAELKGLLDDLSSLISSLPDASRQASIHKLQSRVEVITKLATSAPSRRSKVKDMSAEVVDSNPYSRLMALQRMGIVHNYERIREFSVAIVGIGGVGSVAAEMLTRCGIGRLLLYDYDKVELANMNRLFFRPDQVGMTKTDAAVQTLSEINPDVVLESYTMNITTVQGFETFVSSLKSKSFRPSKEGTGVDLVLSCVDNYEARMAVNQACNELNQTWMESGVSEDAVSGHIQLLIPGETACFACAPPLVVASGVDERTLKREGVCAASLPTTMGVVAGLLVQNTLKFLLQFGHVSPYLGYNSLKDYFPTMEMKPNPQCSNAACLERQKEYIIAKPARDAAAKAKMEAEASLATEIPLHTDNEWNISVVDDSEPETKDATSSADKLPEGLARELPTADEFQKFPAAETSTTTFDDLEELKKQLEALNTD

SEQ ID NO: 7813 - protein, 162 aa, Raphanus sativus
MTIALTIGGNGFSGLSGSSFSSSSSSFRLKNSRRKDTKMLNRTRVVCSSSSVMDPYKTLQIRPDSSEYEVKQAFRQLAKKYHPDVCRGSNCGVQFQTINEAYDIVLKQIKNQMEGTEEFEPFDVYDEGFNGMNDPDCDTWEEWMGWEGAGTRDYSSHVNPYA

SEQ ID NO: 7814 - protein, 209 aa, Raphanus sativus
  misc_feature (42)..(42): Xaa can be any naturally occurring amino acid
  misc_feature (74)..(74): Xaa can be any naturally occurring amino acid
  misc_feature (155)..(155): Xaa can be any naturally occurring amino acid
RPLQHNKWSNGKDGFLVTDIWGKDATPTIWLRQTQERVHLLXYQHKCLTLVLLVPTMAIVNGELDISFVKHQVXENASAKILKVEEKLSKGWGGENAYHVSGYRYLLVDNDTEVSRASPSGKVATLAKETLLAVNKLRETVDAEKSRTKEEKDMXICIRAKNNAWAIARLTRGKELYMALEKASDTLLDATDSVQSFSNRYCNGTFSMD

SEQ ID NO: 7815 - protein, 162 aa, Raphanus sativus
MTIALTIGGNGFSGLSGSSFSSSSSSFRLKNSRRKDTKMLNRTRVVCSSSSVMDPYKTLQIRPDSSEYEVKQAFRQLAKKYHPDVCRGSNCGVQFQTINEAYDIVLKQIKNQMEGTEEFEPFDVYEEGFNGMNDPDCDTWEEWMGWEGAGTRDYSSHVNPYA

SEQ ID NO: 7816 - protein, 306 aa, Brassica oleracea
LVGVLDSCAGTLRCHSVILFHDLLVSTTLSPDDTVDLFTFSVMRLTSNALSSGTSSWSYLRKGTSLSQTSSKSTSPQLLVSSDSLPSGNGHDAGRVIRPLQHNKWIKKGKMFLVTDIWGKDATPTIWLHQRQERVHLLAYQQKCLTLVLLVPTEAIVNGELDISFVKHQVIENATAKILKVEEKLSKGWGGENAYHVSGYRYLLVDNDMEVSRASPSGKVATLAKETLLAVNKLRETVDTEKSRTKEEKDMEICIRAKNNAWAIARVTRGKELYMALEKASDTLLDATDSVQSFSNRYCNGTFSMD

SEQ ID NO: 7817 - protein, 511 aa, Brassica napus
  misc_feature (497)..(497): Xaa can be any naturally occurring amino acid
MGMASMNSSGESLKLCVFDLRRGQNEGQELDKILFFYPPDVTFSTQLSVIGLSEGLITFTRLFSPEAACEVIEAERHSHVFHEAEPDIWMVMVVEKNKEIEAIWRVDALQKVLKEVHSLFVMFHGSVRSLLDKEPSGGLIRSHLYPFITDYLNDLSVGKKLQLPSFRETLKERGTVQMLTLARDAALEVQSLVGVLDSCAGTLRCHSVLLYHDLLVSTTLSPDDTVDLFTYSVMRLTSNALSSGTSSWSYLRKGTSLSQTSSRSISPQLLGSSDSLPSNGNDAGRVIRPLQHNKWSKGKDGFLVTDIWGKDATPTIWLHQRQERVHLLAYQHKCLTLVLLVPTEAIVNGELDISFVKHQVTENGTAKILKVEEKLSKGWGGENAYHVSGYRYLLVDNDMEVSRASPSGKVATLAKETLLAVNKLRETVDTEKSRTKEEKDMEICIRAKNNAWAIARVTRGKELYMALEKASDTLLDATDSVQSFSNRYCNGTFSMDXSSAIFFNYSRDNFH

SEQ ID NO: 7818 - protein, 162 aa, Brassica napus
MTIALTIGGNGFSGLSGSSFSSSSSSFRLKNSKRKDTKMLNRTGVVCSSSSVMDPYKTLKIRPDSSEYEVKQAFRQLAKKYHPDVCRGSNCGVQFQTINEAYDIVLKQIKNQMEGTEEFQPFDVYDEGFNGMNDPDCDTWEEWMGWEGAGTRDYSSHVNPYA

SEQ ID NO: 7819 - protein, 162 aa, Brassica napus
MTIALTIGGNGFSGLSGSSFSSSSSSFRLKNSRRKDTKMLNRTGVVCSSSSVMDPYKTLKIRPDSSEYEVKQAFRQLAKKYHPDVCRGSNCGVQFQTINEAYNIVLKQIKNQMEGTEEFQPFDVYDEGFNGMNDPDCDTWEEWMGWEGAGTRDYSSHVNPYA

SEQ ID NO: 7820 - protein, 162 aa, Raphanus sativus
MTIALTIGGNGFSGLTGSSFSSSSSSFRLKNSRRKDTKMLNRTRVVCSSSSVMDSYKTLQIRPDSSEYEVKQAFRQLAKKYHPDVCRGSNCGVQFQTINEAYDIVLKQIKNQMEGTEEFEPFDVYDEGFNGMNDPDCDTWEEWMGWEGAGTRDYSSHVNPYA

SEQ ID NO: 7821 - protein, 162 aa, Raphanus sativus
  misc_feature (69)..(69): Xaa can be any naturally occurring amino acid
  misc_feature (96)..(96): Xaa can be any naturally occurring amino acid
MTIALTIGGNGFSGLSGSSFSSSSSSFRLKNSRRKDTKMLNRTRVVCSSSSVMDPYKTLQIRPDSSEYXVKQAFRQLAKKYHPDVCRGSNCGVQFXTINEAYDIVLKQIKNQMEGTEEFEPFDVYDEGFNGMNDPDCDTWEEWMGWEGAGTRDYSSHVNPYA

SEQ ID NO: 7822 - protein, 162 aa, Brassica rapa
MTIALTIGGNGFSGLSGSSFSSSSSSFRLKNSRRKDTKMLNRTGVVCSSSSVMDPYKTLKIRPDSSEYEVKQAFRQLAKKYHPDVCRGSNCGVEFQTINEAYNIVLKQIKNQMEGTEEFQPFDVYDEGFNGMNDPDCDTWEEWMGWEGAGTRDYSSHVNPYA

SEQ ID NO: 7823 - protein, 162 aa, Thellungiella halophila
MTIALTIGGNGFSGLPGSSFSSSSSSFRLKNSRRKNTKMLSRTGVICSSSSVMDPYKTLMIRPDSSEYEVKKAFRQLAKKYHPDVCRGSNCGVQFQTINEAYDIVLKQIKNQMEGTEEFEPFDVSDDGFNGMNDPDCDTWEEWMGWEGAGIRDYSSHVNPYA

SEQ ID NO: 7824 - protein, 110 aa, Brassica napus
MDPYKTLKIRPDSSEYEVKQAFRQLAKKYHPDVCRGSNCEVQFQTINEAYNIVLKQIKNQMEGTEEFQPFDVYDEGFNGMNDPDCDTWEEWMGWEGAGTRDYSSHVNPYA

SEQ ID NO: 7825 - protein, 124 aa, Raphanus sativus
MLNRTGVVCSSSSVMDPYKTLKIRPDSSEYEVKQAFRQLAKKYHPDVCRGSNCGVQFQTINEAYDIVLKQIKNQMDGTKEYEPFDVYDDGFNGMNDPDCDTWEEWMGWEGAGTRDYSSHVNPYA

SEQ ID NO: 7826 - protein, 151 aa, Brassica oleracea
MTIALTIGGNVFSGLSGSKSSRRKNAKMLNRTRVVCSSSSVMDPYKTLKIRPDSSEYEVKQAFRQLAKKYHPDVCRGNNCGVQFQTINEAYNIVLKQIKNQMEGTEEFQPFDVYDEGFNGMNDPDCDTWEEWMGWEGAGTRDYSSHVNPYA

SEQ ID NO: 7827 - protein, 151 aa, Brassica napus
MTIALTIGGNVFSGLSGSKSSIRKNAKMLNRTRVVCSSSSIMDPYKTLKIRPDSSEYEVKQAFRQLAKKYHPDVCRGNNCGVQFQTINEAYNIVLKQIKNQMEGTEEFQPFDVYDEGFNGMNDPDCDTWEEWMGWEGAGTRDYSSHVNPYA

SEQ ID NO: 7828 - protein, 151 aa, Brassica rapa
MTIALPIGGNVFSGLSGSKSSRRKNPKMLNRTRVVCSSSSIMDPYKTLKIRPDSSEYEVKQAFRQLAKKHHPDVCRGNNCGVQFQTINEAYNIVLKQIKNQMEGTEEFQPFDVYDEGFNGMNDPDCDTWEEWMGWEGAGTRDYSSHVNPYA

SEQ ID NO: 7829 - protein, 378 aa, Unknown
  Sequence found in Organisms: Brassica napus, Brassica rapa
MAKMMMMQQSQPSLSLLTSSVSDFNGAKLHLQVQYKRKVQQPKGALYVSASSEKKILIMGGTRFIGIFLSRLLVKEGHQVTLFTRGKSPIAKQLPGESDQDFADFSSKILHLKGDRKDYDFVKSSLSAEGFDVVYDINGREAEEVEPILDALPKLEQYIYCSSAGVYLKSDVLPHCEVDAVDPKSRHKGKLETESLLQSKGVNWTSIRPVYIYGPLNYNPVEEWFFHRLKAGRPIPVPNSGIQISQLGHVKDLATAFLAVLGNEKASREIFNISGEKYVTFDGLARACAKAGGFPEPEIVHYNPKEFDFGKKKAFPFRDQHFFASVEKAKHVLGWKPEFDLVEGLTDSYNLDFGRGTFRKEADFTTDDMILSKKLVLQ

SEQ ID NO: 7830 - protein, 228 aa, Brassica napus
MEEGDFFSCFSEINSGMTMNKKKMRKGTNHKRFSEEQIKSLEVIFESETRLEPRKKVQLARELGLQPRQVAIWFQNKRARWKSKQLEKEYDILRANYNNLASQFEIIKKEKQALVSELQRLNEEMRKTKEERNDECCGEQRVALSSSTWSDNGKYEPEVRVNQGIVLCNDDIKTEYFGFEEESNHELINIVEQADDSGLTSSDNWGNFNSESFLDQSSSNYPWWDFWS

SEQ ID NO: 7831 - protein, 229 aa, Raphanus sativus
  misc_feature (116)..(116): Xaa can be any naturally occurring amino acid
  misc_feature (210)..(210): Xaa can be any naturally occurring amino acid
MEEGDFISCFSEINSGMTMNKKKMRKGTNHKRFSEEQIKSLEVIFESETRLEPRRKVQLARELGLQPRQVAIWFQNKRARWKSKQLEKEYNILSANYNNLASQFEIMKKEKQALVXELQRLNEEMKKTREERNDECCAEQRVALGSSTWSDNGNYEPEVRLNQGIVLCNDDIKSEYFGFEEESNHELMNIVDQADDSGLTSSDNWGDFNXESLLDQSSSTTLGGIFGHK

SEQ ID NO: 7832 - protein, 229 aa, Brassica napus
MEEGDAFNCCFSEINSGMSMNKNKKKMKKSNNQKRFSEEQIKSLEVIFESETRLEPRKKVQVARELGLQPRQVAIWFQNKRARWKTKQLEKEYNILRANYNNLASQFDIMKKEKQALVSQLQRLNEEMHKSKEERRDEYCGEQRVALSSTTRSENGKCEPEVRINQGIVLCNDDIKTEYFGFEESNHVLMNIVEQADDSCLTSSDNWGGFNSDSILDQSSNYPWWDFWS

SEQ ID NO: 7833 - protein, 229 aa, Brassica juncea
MEEGDVFNCCFGEINSGMCMNKKKMKKSNNQKRFSEEQIKSLEVIFESETRLEPRKKVQVARELGLQPRQVAIWFQNKRARWKTKQLEKEYNILRANYNNLASQFDTMKKEKQALVFELQRLNEEMRKSKEERRDECCGEQRVALSSTTGSENEKCEPEVRINQGIGLCNDDIKTEYFGFEEESNHEFMNIVEQADDSCLTSSDRWGGFKSDSILDQSSSNYPWWDFWS

SEQ ID NO: 7834 - protein, 231 aa, Raphanus sativus
  misc_feature (157)..(157): Xaa can be any naturally occurring amino acid
MEEGDVFNCCFSEINSGISMSKKKMKKSNTQKRFSEEQIKSLEVIFESETRLEPRKKVQVARELGLQPRQVAIWFQNKRARWKTKQLEKEYNILRANYNNLASQFDIMKKEKQALVSELQRLNEEMQKSKEERRDECCGEQRIALSSTTWSENGKCXPEVRINQEIVLCNDDIKTEYFGFEEESNHEPTNIVEQADDSCLTSSDNWGGFNSDSILDQSSSNYPWWDFGHNS

SEQ ID NO: 7835 - protein, 236 aa, Arabidopsis lyrata
MEEGDLFNCCFSEINSGMTMNKKKMKKKSNNQKRFSEEQIKSLELIFESETRLEPRKKVQVARELGLQPRQVAIWFQNKRARWKTKQLEKEYNILRSNYNNLASQFEIMKKEKQSLVTELQRQNEEMQKPKEEKHHECCGDQGVALSSSTESHNGKSEPEVRLNQGIVLCDDGDYNNNIKTEYFGFEEETDHELMNIVEKADDSCLTSSENWGGFNSDSLLDQSSSNYPNWWEFWS

SEQ ID NO: 7836 - protein, 235 aa, Arabidopsis thaliana
MEEGDFFNCCFSEISSGMTMNKKKMKKSNNQKRFSEEQIKSLELIFESETRLEPRKKVQVARELGLQPRQVAIWFQNKRARWKTKQLEKEYNTLRANYNNLASQFEIMKKEKQSLVSELQRLNEEMQRPKEEKHHECCGDQGLALSSSTESHNGKSEPEGRLDQGSVLCNDGDYNNNIKTEYFGFEEETDHELMNIVEKADDSCLTSSENWGGFNSDSLLDQSSSNYPNWWEFWS

SEQ ID NO: 7837 - protein, 194 aa, Raphanus sativus
MAEETKNVEVPKVESEESSAAATEVTDRGLFDFLGKKKDETKPEETAIASEFEQKVHVSEPAPEVKHVEEEEEKKHHSLLEKLHRSDSSSSSSSEEEGEDGVKRKKKKDKKKVTSEGEVKTEEEEKKGFMDKLKEKLPGHGKKPEDAPPAPVVAPPVEEAHPAEKKGILEKIKEKLPGYHPKTVEEEKKDKDDH

SEQ ID NO: 7838 - protein, 195 aa, Raphanus sativus
MAEETKNVEVPKVESEESSAAATEVTDRGLFDFLGKKKDETKPEETAIASEFEQKVHVSEPAPEVKHEEEEEEKKHHSLLEKLHRSDSSSSSSSEEEGEDGVKRKKKKDKKKVTSEGGEVKTEEEEKKGFMDKLKEKLPGHGKKPEDAPPAPVVAPPVEEAHPAEKKGILEKIKEKLPGYHPKTVEEEKKDKDDH

SEQ ID NO: 7839 - protein, 195 aa, Raphanus sativus
MAEETKNVEVPKVESEESSAAATEVTDRGLFDFSGKKKDETKPEETAIASEFEQKVHVSEPAPEVKHVEEEEEKKHHSLLEKLHRSDSSSSSSSEEEGEDGVKRKKKKDKKKVTTEGEVKTEEEEKKGFMDKLKEKLPGHGKKPEDAPPPAPVVAPPVEEAHPAEKKGILEKIKEKLPGYHPKTVEEEKKDKDDH

SEQ ID NO: 7840 - protein, 195 aa, Raphanus sativus
MAEETKNIEVPKVESEESSAGATEVTDRGLFDFLGKKKDETKPEETAIASEFEQKVHVSEPAPEVKHEEEEEEKKHHSLLEKLHRSDSSSSSSSEEEGEDGVKRKKKKDKKKVTTEGGEVKTEEEEKKGFMDKLKEKLPGHGKKPEDAPPAPVVAPPVEEAHPAEKKGILEKIKEKLPGYHPKTVEEEKKDKDDH

SEQ ID NO: 7841 - protein, 194 aa, Raphanus sativus
MAEETKNVEVPKVASEESSAGATEVTDRGLFDFLGKKKDETKPEETAIASEFEQKVHVSEPAPEVKHEKEEEEKKHHSLLEKLHRSDSSSSSSSEEEGEDGVKRKKKKDKKKVTTEGEVKIEEEEKKGFMDKLKEKLPGHGKKPEDAPAAPVVAPPVEEAHPAEKKGILEKIKEKLPGYHPKTVEEEKKDKDDH

SEQ ID NO: 7842 - protein, 195 aa, Raphanus sativus
  misc_feature (114)..(114): Xaa can be any naturally occurring amino acid
  misc_feature (150)..(150): Xaa can be any naturally occurring amino acid
MAEETKNVEVPKVASEESSAAATEVTDRGLFDFLGKKKDETKPEETAIASEFEQKVHVSEPAPEVKHVEEEEKKHHSLLEKLHRSDSSSSSSSEEEGEDGVKRKKKKDKKKVTXEGGEVKTEEEEKKGFMDKLKEKLPGHGKKPEDATPXAPVVAPPVEEAHPAEKKGILEKIKEKLPGYHPKTVEEEKKDKDDH

SEQ ID NO: 7843 - protein, 220 aa, Brassica napus
MGSEGPTAVTINITGFKKFHGVAENPTEKMANNLKEYLAKNPQSKDVVLGSCTVLETAGQGALASLYQLLQSAINTKESESVTCGKTIWVHFGVNSGATKFAIEQQAVNEATYRCPDELGWKPQHLPIVPSDGPISTVRKTTLPVEEITKALEKKGFEVITSDDAGRFVCNYVYYHSLRFAEQNKTYSLFVHVPLFVAVDEETQMRFTASLLEVLTSVCK

SEQ ID NO: 7844 - protein, 220 aa, Brassica napus
MGSEGPTAVTINITGFKKFHGVAENPTEKMANNLKEYLAKNPQSKDVVLGSCTVLETAGQGALASLYQLLQSAINTKESESVTCGKTIWVHFGVNSGATKFAIEQQAVNEATFRCPDELGWKPQHLPIVPSDGPISTVRKTTLPVEEITKALEKKGFEVITSDDAGRFVCNYVYYHSLRFAEQNKTYSLFVHVPLFVAVDEETQMRFTASLLEVLASVCK

SEQ ID NO: 7845 - protein, 220 aa, Brassica rapa
MGSEGPTAVTINITGFKKFHGVAENPTEKMANNLKEYLAKNPQSKDVVLGSCTVLETAGQGALASLYQLLQSAINTKESESVTCGKTIWVHFGVNSGATKFAVEQQAVNEATFRCPDELGWKPQHLPIVPSDGPISTVRKTTVPVEEITKALEKKGFEVITSDDAGRFVCNYVYYHSLRFAEQNKTYSLFVHVPLFVAVDEETQMRFTASLLEVLASVCK

SEQ ID NO: 7846 - protein, 220 aa, Raphanus sativus
MGSEGPTAVTINITGFKKFHGVAENPTEKIASNLKEYLAKNPQSKDVVLGSCTVLETAGQGALASLYQLLQSSINTKESESVSCGKTIWVHLGVNSGATKFAIEQQAVNEATFRCPDEMGWKPQHLPIVPSDGPISTVRKTTLPVEEITKALEKKGFEVITSDDAGRFVCNYVYYHSLRFAEQNKTYSLFVHVPLFVAVDEETQMRFTASLLEVLTSVCK

SEQ ID NO: 7847 - protein, 220 aa, Raphanus sativus
MGSEGPTAVTINITGFKKFHGVAENPTEKIASYLKEYLAKNPQSKDVVLGSCTVLETAGQGALASLYQLLQSAINTKELESVSCGRTIWVHLGVNSGATKFAIEQQAVNEATFRCPDEMGWKPQHLPIVLSDGPISTVRKTTLPVEEITKALEKKGFEVITSDDAGRFVCNYVYYHSLRFAEQNKTYSLFVHVPLFVAVDEETQMRFTASLLEVLTSVCK

SEQ ID NO: 7848 - protein, 143 aa, Brassica rapa
MATTSTSTGDIKKTKSVEVKKKLNVLIVDDDTVIRKLHENIIKSIGGISQTAKNGEEAVNIHRDGNASFDLILMDKEMPERDGLSATKKLREMKVTAMIIGVTTLADNEEERKAFMEAGLNHCLAKPLSKAKILPLINNLMDA

SEQ ID NO: 7849 - protein, 141 aa, Brassica napus
MATTSTGDIEKTKSVEVKKKLNVLIVDDDPVIRKLHEIIIKSIGGISQTAKNGEEAVNIHRDGNASFDLILMDKEMPERDGLSATKKLREMKVTSMIIGVTTLADNEEERKAFMEAGLNHCLAKPLSKAKILPLINNLMDA

SEQ ID NO: 7850 - protein, 166 aa, Brassica napus
QRRVRGEFTIFFRIQNHCSKKKKPKMATTSTGDIEKTKSVEVKKKLNVLIVDDDPVIRKLHEIIIKSIGGISQTAKNGEEAVNIHRDGNASFDLILMDKEMPERDGLSATKKLREMKVTSMIIGVTTLADNEEERKAFMEAGLNHCLAKPLSKAKILPLINNLMDA

SEQ ID NO: 7851 - protein, 225 aa, Brassica napus
MATNEPEHEHRDAEESGANEDEDTGAQVAPIVRLEEVAVTTGEEDEDAVLDLKSKLYRFDKEANQWKERGAGTVKLLKHKSTGKIRLVMRQSKTLKICANHFVKQGMSVQEHVGNEKSCVWHARDFADGELKDELFCIRFASIENCKAFMQKFNEVAESEVEKEESKDASDAAGLLEKLTVEETKTEEKPVEKVKTEVEPEEKTKTEPEKADEEKKTEEAVAPST

SEQ ID NO: 7852 - protein, 225 aa, Brassica napus
MATNEPEHENRDAEESGANEDEDTGAQVAPIVRLEEVAVTTGEEDEDAVLDLKSKLYRFDKEANQWKERGAGTVKLLKHKSTGKIRLVMRQSKTLKICANHFVKTGMSVQEHVGNEKSCVWHARDFADGELKDELFCIRFASIENCKAFMQKFNEVAESEVEKEESKDASDAAGLLEKLTVEETKTEEKPVEKVKTEVEPEEKITTEPEKADEEKKTEEAAAPST

SEQ ID NO: 7853 - protein, 225 aa, Raphanus sativus
MATNEPEHENRDAEESGANEDEDTGAQVAPIVRLEEVAVTTGEEDEDAILDLKSKLYRFDKEANQWKERGAGTVKLLKHKSTGKIRLVMRQSKTLKICANHFVKQGMSVQEHVGNEKSCVWHARDFADGELKDELFCIRFASIENCKAFMQKFNEVAESEVEKEESKDASDTAGLLEKLTVEETKTEEKPVEKVKAEVEAEEKTKSEPEKADEEKKTEEAVAPST

SEQ ID NO: 7854 - protein, 224 aa, Raphanus sativus
MATNEPEHENRDAEESGANEDEDTGAQVAPIVRLEEVAVTTGEEDEDAILDLKSKLYRFDKEANQWKERGAGTVKLLKHKSTGKIRLVMRQSKTLKICANHFVKQGMSVQEHVGNEKSCVWHARDFADGELKDELFCIRFASIENCKAFMQKFNEVAESEVEKEESKDASDTAGLLEKLSVEETKTEEKPVEKVKTEVEAEEKTKTEPEKAGEEKKTEEAAPST

SEQ ID NO: 7855 - protein, 217 aa, Brassica napus
MATNEPEHEHRDAEESGANEDEDTGAQVAPIVRLEEVAVTTGEEDEDAVLDLKSKLYRFDKEANQWKERGAGTVKLLKHKSTGKIRLVMRQSKTLKICANHFVKQGMSVQEHVGNEKSCVWHARDFADGELKDELFCIRFASIENCKAFMQKFNEVAESEVEKEESKDASDAAGLLEKLTVEETKTEEKVKTEEKTKTEPEKADEEKKTEEAVAPST

SEQ ID NO: 7856 - protein, 225 aa, Brassica oleracea
  misc_feature (81)..(81): Xaa can be any naturally occurring amino acid
  misc_feature (108)..(108): Xaa can be any naturally occurring amino acid
  misc_feature (154)..(154): Xaa can be any naturally occurring amino acid
MATNEPEHETRDAEEAGANEDEDTGAQVAPIVRLEEVAVTTGEEDEDAVLDLKSKLYRFDKEANQWKERGAGTVKLLKHKXTGKIRLVMRQSKTLKICANHFVKPGMXVQEHVGNEKSCVWHARDFADGELKDELFCIRFASIENCKAFMQKFXEVAESEVEKEESKDASDTAGLLEKLTVEETKTEEKPVEKVKTEVEPEEKTKSEPEKADEEKKTEEAVAPST

SEQ ID NO: 7857 - protein, 224 aa, Brassica rapa
MATNEPEHEPRDVEEAGANEDEDTGAQVAPIVRLEEVAVTTGEEDEDAVLDLKSKLYRFDKEANQWKERGAGTVKLLKHKSTGKIRLVMRQSKTLKICANHFVTQGMSVQEHVGNEKSCVWHARDFADGELKDELFCIRFASIENCKAFMQKFNEVAESEVEKEESKDASDTAGLLEKLTVEETKTEEKPVEKEKTEVEAEEKKKSEPEKADEEKKTEEAVPST

SEQ ID NO: 7858 - protein, 224 aa, Brassica napus
  misc_feature (179)..(179): Xaa can be any naturally occurring amino acid
  misc_feature (197)..(197): Xaa can be any naturally occurring amino acid
  misc_feature (201)..(201): Xaa can be any naturally occurring amino acid
MATNEPEHEHRDVEEAGANEDEDTGAQVAPIVRLEEVAVTTGEEDEDAVLDLKSKLYRFDKEANQWKERGAGTVKLLKHKSTGKIRLVMRQSKTLKICANHFVTQGMSVQEHVGNEKSCVWHARDFADGELKDELFCIRFASIENCKAFMQKFNEVAESEVEKEESKDASDTAGLLEKXTVEETKTEEKPVEKEKTXVEAXEKRKSEPEKADEEKKTEEAVPST

SEQ ID NO: 7859 - protein, 217 aa, Brassica napus
MATNEPEHENRDAEESGANEDEDTGAQVAPIVRLEEVAVTTGEEDEDAVLDLKSKLYRFDKEANQWKERGAGTVKLLKHKSTGKIRLVMRQSKTLKICANHFVKTGMSVQEHVGNEKSCVWHARDFADGELKDELFCIRFASIENCKAFMQKFNEVAESEVEKEESKDASDAAGLLEKLTVEETKTEEKVKTEEKITTEPEKADEEKKTEEAAAPST

SEQ ID NO: 7860 - protein, 226 aa, Raphanus sativus
MATTNEPEHEHRDAEEAGANEDEDTGAQVAPIVRLEEVAVTTGEEDEDAVLDLKSKLYRFDKEANQWKERGGGTVKLLKHKSTGKIRLVMRQSKTLKICANHFVKQGMSVQEHVGNEKSCVWHARDFADGELKDELFCIRFASIENCKAFMQKFNEVAESEVVEKEESKDASDTAGLLEKLSVEESKTEEKPVEKEKTEVEAEEKKKSEPEKADEVKKTEEASPST

SEQ ID NO: 7861 - protein, 225 aa, Raphanus sativus
MATNEPEHEHRDAEEAGANEDEDTGAQVAPIVRLEEVAVTTGEEDEDAVLDLKSKLYRFDKEANQWKERGGGTVKLLKHKSTGKIRLVMRQSKTLKICANHFVKQGMSVQEHVGNEKSCVWHARDFADGELKDELFCIRFASIENCKAFMQKFNEVAESEVVEKEESKDASDTAGLLEKLSVEESKTEEKPVEKEKTEVEAEDKKKSEPEKADEVKKTEEASPSA

SEQ ID NO: 7862 - protein, 216 aa, Brassica napus
MATNEPEHEPRDVEEAVANEDEDTGAQVAPIVRLEEVAVTTGEEDEDAVLDLKSKLYRFDKEANQWKERGAGTVKLLKHKSTGKIRLVMRQSKTLKICANHFVTQGMNVQEHVGNEKSCVWHARDFADGELKDELFCIRFASIENCKAFMQKFNEVAESEVEKEESKDASDTAGLLEKLTVEETKTEEKEKTEEKRKSEPEKADEEKKTEEAVPST

SEQ ID NO: 7863 - protein, 216 aa, Brassica napus
MATNEPEHEHRDVEEAGANEDEDTGAQVAPIVRLEEVAVTTGEEDEDAVLDLKSKLYRFDKEANQWKERGAGTVKLLKHKSTGKIRLVMRQSKTLKICANHFVTQGISVQEHVGNEKSCVWHARDFADGELKDELFCIRFASIENCKAFMQKFNEVAESEVEKEESKEASDTAGLLEKLTVEETKTEEKEKTDEKKKDEPEKAGEEKKTEEASPST

SEQ ID NO: 7864 - protein, 208 aa, Raphanus sativus
  misc_feature (33)..(33): Xaa can be any naturally occurring amino acid
  misc_feature (42)..(42): Xaa can be any naturally occurring amino acid
  misc_feature (65)..(65): Xaa can be any naturally occurring amino acid
GANEDEDTGAQVAPIVRLEEVAVTTGEEDEDAXLDLKSKLYXFDKEANQWKERGAGTVKLLKHKXTGKIRLVMRQSKTLKICANHFVKQGMSVQEHVGNEKSCVWHARDFADGELKDELFCIRFASIENCKAFMQKFNEVAESEVEKEESKDASDTAGLLEKLSVEETKTEEKSVEKLKTEVEAEEKTKTEPEKADEEKKTEEAAPST

SEQ ID NO: 7865 - protein, 197 aa, Brassica napus
MATNEPEHETRDAEEAGANEDEDTGAQIAPIVRLEEVAITTGEEDEDAVLDLKSKLYRFDKEANQWKERGAGTVKLLKHKDTGKIRLVMRQSKTLRICANHFVKPGMAVQEHVGNEKSCVWHARDFADGELKDELFCIRFASIENCKLFMQKFNEVAESEVEKEESKDASETAGLLEKLTVEETKTEEKVKTEEKKK

SEQ ID NO: 7866 - protein, 243 aa, Brassica napus
MGYWNSKVVPRFKKIFEKNSAKKAAAAEACKTFDESKETINKEIEEKKTELQPKVVETYEATSAEVKALVRDPKEAGLKKNSAAVLKYLEALVGIEFPGSTAVKEAASSFGAGYVSGPVTFIFEKVCVFLPEEVKTREVPVEEAKTEEPVKTEDPAKTEEPVKTEETSGEKEKEIVEETKKEEIVATSVVEEKKPEVEKEEEKKPVVEEVKKEEAASAPAVVETPVTAPETTTPAPVAEPPKP

SEQ ID NO: 7867 - protein, 243 aa, Brassica rapa
MGYWNSKVVPRFKKIFEKNSAKKAAAAEACKTFDESKETINKEIEEKKTELQPKVVETYEATSAEVKALVRDPKEAGLKKNSAAVLKYLEALVGIEFPGSTAVKEAASSFGAGYVSGPVTFIFEKVCVFLPEEVKTREVPVEEAKTEEPVKTEDPAKTEEPVKTEETSGEKEKEIVEETKKEEIVATSVVEEKKPEVEKEEEKKPVVEEVKKEEASSAPAVVETPVTAPETTTPAPVAEPPKP

SEQ ID NO: 7868 - protein, 242 aa, Raphanus sativus
MGYWNSKVVPRFKKIFEKNSAKKAAAAEACKTFDESKETINKEIEEKKTELQPKVVETYEATSAEVKALVRDPKEAGLKKNSAAVLKYLEALVGIEFPGSTAVKEAASSFGAGYVSGPVGFIFEKVCVFLPEEVKTREVPVEEVKAEEPAKTEEPAKTEEPVKTEETSGEKEIVEEKKEETVATAVVEEKKPEVEKEEEKKPVVEEVKKEEAAPAPAPAVVETPVTAPETTTPAPVAEPPKP

SEQ ID NO: 7869 - protein, 243 aa, Raphanus sativus
MGYWNSKVVPRFKKIFEKNSAKKAAAAEACKTFDESKETINKEIEEKKTELQPKVVETYEATSAEVKALVRDPKEAGLKKNSAAVLKYLEALVGIEFPGSTAVKEAASSFGAGYVSGPVGFIFEKVCVFLPEEVKTREVPVEEVKTEEPAKTEEPAKTEEPVKTEETSGEKEIVEEKKEETVATAVVEEKKPEVEKEEEKKPVVEEVKKEEAAPAPAPAVVETPVTAPAETTTPAPVAEPPKP

SEQ ID NO: 7870 - protein, 245 aa, Thellungiella halophila
MGYWNSKVVPKFKKIFEKNSTKKAAAAEACKTFDESKEAINKEIEEKKTELQPKVVETYEATSAEVKALVRDPKEAGLKKNSAAVQKYLEALVNIEFPGSTAVKDASSSFGAGYVAGPITFIFEKVCVFLPEEVKTREVPVETAKTEEPAKTEEPAKTEEPAKTEETSGEKEKEIVEKPKKEETVTTAVVEEKKPEVEKEEEKKPVEEVKKEEEAAPAPAPAVVETPVKEPETTTPAPVAEAPKP

SEQ ID NO: 7871 - protein, 237 aa, Brassica rapa
MGYWNSKVVPRFKKIFEKSSVKKAAAAEACKTFDESKEAINKEIEEKKTELQPKVVETYEATSAEVKALVRDPKEAGVKKNSAAVQKYLEALAAIEFPGSTAAKDAASSFGAGYVSGPVMFIFEKVCVFLPEEVKTREIPVEEVKAEEPAKTEEPAKTEESAKTEESSGEKEEIVEETVTTAVVEEHKPEVAKEEEKKPEEVKKEEAAPPPAPELVESPVKAPETKTPAPVAEPSKP

SEQ ID NO: 7872 - protein, 842 aa, Saccharum officinarum
MGRWWPAALLGCAVAVAVLAGAVECAVTYDKKAVLIDGQRRILFSGSIHYPRSTPDMWEGLIQKAKDGGLDVIQTYVFWNGHEPTPGNYYFEERYDLVRFIKTVQKAGLFVHLRIGPYICGEWNFGGFPVWLKYVPGISFRTDNEPFKTAMQGFTEKIVGMMKSENLFASQGGPIILSQIENEYGPEGKEFGAAGQAYINWAAKMAIGLGTGVPWVMCKEEDAPDPVINACNGFYCDAFSPNKPYKPTMWTEAWSGWFTEFGGTIRQRPVEDLAFAVARFVQKGGSFINYYMYHGGTNFGRTAGGPFITTSYDYDAPIDEYGLVREPKHSHLKELHRAVKLCEQALVSVDPAITTLGTMQEAHVFRSPSGCAAFLANYNSNSYAKVVFNNEQYSLPPWSISILPDCKNVVFNSATVGVQTSQMQMWGDGASSMMWERYDEEVDSLAAAPLLTTTGLLEQLNVTRDSSDYLWYITSVDISPSESFLQGGGKPLSLSVLSAGHALHVFVNGQLQGSAYGTREDRRIKYNGNANLRAGTNKIALLSVACGLPNVGVHYETWNTGVGGPVVLHGLNEGSRDLTWQTWSYQVGLKGEQMNLNSLEGSTSVEWMQGSLIAQNQQPLSWYRAYFETPSGDEPLALDMGSMGKGQIWINGQSIGRYWTAYADGDCKECSYTGTFRAPKCQTGCGQPTQRWYHVPRSWLQPTRNLLVVFEELGGDSSKIALVKRSVSSVCADVSEDHPNIKNWQIESYGEREYHRAKVHLRCAPGQSISAIKFASFGTPMGTCGNFEQGDCHSANSHTVLEKKCIGLQRCVVAISPESFGGDPCPSVTKRVAVEAVCSPTV

SEQ ID NO: 7873 - protein, 183 aa, Zea mays
MGRWWPAALLGCAVAVVAVLAAAVVECAVTYDKKAVLIDGQRRILFSGSIHYPRSTPDMWEGLIQKAKDGGLDVIQTYVFWNGHEPTPGNYYFEERYDLVRFVKTVQKAGLFVHLRIGPYICGEWNFGGFPVWLKYVPGISFRTDNEPFKTAMQGFTEKIVGMMKSENLFASQGGPIILSQAN

SEQ ID NO: 7874 - protein, 819 aa, Pennisetum glaucum
VECAVTYDKKAVLIDGQRRILFSGSIHYPRSTPDMWEGLIQKAKDGGLDVIQTYVFWNGHEPTPGNYYFEERYDLVRFVKTVQKAGLFVHLRIGPYICGEWNFGGFPVWLKYVPGISFRTDNEPFKTAMQGFTEKIVGMMKSENLFASQGGPIILSQIENEYGPEGKEFGAAGQSYINWAAKMAVGLGTGVPWVMCKEEDAPDPVINACNGFYCDAFSPNKPYKPMMWTEAWSGWFTEFGGTIRQRPVEDLAFAVARFVQKGGSFINYYMYHGGTNFGRTAGGPFITTSYDYDAPIDEYGLVREPKHSHLKELHRAVKLCEQALVSVDPAITTLGTMQEAHVFRSPSGCAAFLANYNSNSYAKVVFNNEHYSLPPWSISILPDCKNVVFNSATVGVQTSQMQMWADGASSMMWERYDEEVDSLAAAPLLTTTGLLEQLNVTRDSSDYLWYITSVEISPSENFLQGGKPLSLSVQSAGHTLHIFINGQLQGSAYGTREDRRIKYNGNANLRAGTNKVALLSVACGLPNVGVHYETWNTGVVGPVVLHGLDEGSRDLTWQTWSYQVGLKGEQMNLNSLQGSSSVEWMQGSLLAQNQQPLAWYRAYFETPSGDEPLALDMGSMGKGQIWINGQSIGRYWTAYANGDCKGCSYTGTFRAPKCQAGCGQPTQRWYHVPRSWLQPTRNLLVVFEELGGDSSKIALVKRSVSSVCADVSEDHPNIKKWQIESYGEREYHRAKVHLKCAPGQSISAIKFASFGTPMGTCGSFQQGDCHSANSHTVVEKKCIGLQRCVVAISPENFGGDPCPNVTKRVAVEAVCSPTA

SEQ ID NO: 7875 - protein, 841 aa, Oryza sativa
MGRGCLAALLGGAVAVAVLVAVVHCAVTYDKKAVLVDGQRRILFSGSIHYPRSTPEMWDGLIEKAKDGGLDVIQTYVFWNGHEPTPGNYNFEGRYDLVRFIKTVQKAGMFVHLRIGPYICGEWNFGGFPVWLKYVPGISFRTDNEPFKNAMQGFTEKIVGMMKSENLFASQGGPIILSQIENEYGPEGKEFGAAGKAYINWAAKMAVGLDTGVPWVMCKEDDAPDPVINACNGFYCDTFSPNKPYKPTMWTEAWSGWFTEFGGTIRQRPVEDLAFGVARFVQKGGSFINYYMYHGGTNFGRTAGGPFITTSYDYDAPLDEYGLAREPKFGHLKELHRAVKLCEQPLVSADPTVTTLGSMQEAHVFRSSSGCAAFLANYNSNSYAKVIFNNENYSLPPWSISILPDCKNVVFNTATVGVQTNQMQMWADGASSMMWEKYDEEVDSLAAAPLLTSTGLLEQLNVTRDTSDYLWYITSVEVDPSEKFLQGGTPLSLTVQSAGHALHVFINGQLQGSAYGTREDRKISYSGNANLRAGTNKVALLSVACGLPNVGVHYETWNTGVVGPVVIHGLDEGSRDLTWQTWSYQVGLKGEQMNLNSLEGSGSVEWMQGSLVAQNQQPLAWYRAYFDTPSGDEPLALDMGSMGKGQIWINGQSIGRYWTAYAEGDCKGCHYTGSYRAPKCQAGCGQPTQRWYHVPRSWLQPTRNLLVVFEELGGDSSKIALAKRTVSGVCADVSEYHPNIKNWQIESYGEPEFHTAKVHLKCAPGQTISAIKFASFGTPLGTCGTFQQGECHSINSNSVLEKKCIGLQRCVVAISPSNFGGDPCPEVMKRVAVEAVCSTAA

SEQ ID NO: 7876 - protein, 897 aa, Zea mays
MGRWWPAALLGCAVAVVAVLAAAVVECAVTYDKKAVLIDGQRRILFSGSIHYPRSTPDVISCILQNLSFFFSPLLPRGGGEFMAVVSCVLDAMLSKANCFPTLAVPLYSTMWEGLIQKAKDGGLDVIQTYVFWNGHEPTPGNYYFEERYDLVRFVKTVQKAGLFVHLRIGPYICGEWNFGGFPVWLKYVPGISFRTDNEPFKTAMQGFTEKIVGMMKSENLFASQGGPIILSQIENEYGPEGKEFGAAGQAYINWAAKMAVGLDTGVPWVMCKEEDAPDPVINACNGFYCDAFSPNKPYKPTMWTEAWSGWFTEFGGTIRQRPVEDLAFAVARFVQKGGSFINYYMYHGGTNFGRTAGGPFITTSYDYDAPIDEYGLIREPKHSHLKELHRAVKLCEQALVSVDPTITTLGTMQEAHVFRSPSGCAAFLANYNSNSHAKVVFNNEQYSLPPWSISILPDCKNVVFNSATVGVQTSQMQMWGDGATSMMWERYDEEVDSLAAAPLLTTTGLLEQLNVTRDSSDYLWYITSVDISPSENFLQGGGKPPSLSVQSAGHALHVFVNGQLQGSSYGTREDRRIKYNGNVNLRAGTNKIALLSVACGLPNVGVHYETWNTGVGGPVVLHGLNEGSRDLTWQTWSYQVGLKGEQMNLNSVEGSGSVEWMQGSLIAQKQQPLAWYKAYFETPSGDEPLALDMGSMGKGQVWINGQSIGRYWTAYADGDCKGCSYTGTFRAPKCQAGCGQPTQRWYHVPRSWLQPSRNLLVVLEELGGGDSSKIALAKRSVSSVCADVSEDHPNIKKWQIESYGEREHRRAKVHLRCAHGQSISAIRFASFGTPVGTCGNFQQGGCHSASSHAVLEKRCIGLQRCVVAISPDNFGGDPCPSVTKRVAVEAVCSPAA

SEQ ID NO: 7877 - protein, 839 aa, Brachypodium distachyon
MARRWPAALLCWAAAAALLAAAVECAVTYDKKAVLIDGQRRILFSGSIHYPRSTPEMWEGLFQKAKDGGLDVIQTYVFWNGHEPTPGNYNFEGRYDLVKFIKTAQKAGLFVHLRIGPYICGEWNFGGFPVWLKYVPGISFRTDNEPFKTAMQGFTEKIVGMMKSEELFASQGGPIILSQIENEYGPEGKSFGAAGKSYSNWAAKMAVGLDTGVPWVMCKQDDAPDPVINACNGFYCDAFSPNKPYKPTMWTEAWTGWFTEFGGTIRKRPVEDLSFAVARFVQKGGSFINYYMYHGGTNFGRTAGGPFITTSYDYDAPLDEYGLAREPKYGHLKELHRAVKLCEPALVSVDPAVTTLGSMQEAHVFRSPSSCAAFLANYNSNSHANVVFNNEHYSLPPWSISILPDCKTVVFNTATVGVQTSQMQMWADGESSMMWERYDEEVGSLAAAPLLTTTGLLEQLNVTRDSSDYLWYITSVDVSPSEKFLQGGEPLSLTVQSAGHALHIFINGQLQGSASGTREAKKFSYKGNANLRAGTNKIALLSIACGLPNVGVHYETWNTGIVGPVVLHGLDVGSRDLTWQTWSYQVGLKGEQMNLNSLEGASSVEWMQGSLLAQAPLSWYRAYFDTPTGDEPLALDMGSMGKGQIWINGQSIGRYSTSYASGDCKACSYAGSYRAPKCQAGCGQPTQRWYHVPKSWLQPSRNLLVVFEELGGDSSKISLVKRSVSSVCADVSEYHTNIKNWQIENAGEVEFHRPKVHLRCAPGQTISAIKFASFGTPLGTCGNFQQGDCHSTKSHAVLEKNCIGQQRCAVTISPDNFGGDPCPKEMKKVAVEAVCSPGT

SEQ ID NO: 7878 - protein, 841 aa, Brachypodium distachyon
MARRWPAALLCWAAAAALLAAAVECAVTYDKKAVLIDGQRRILFSGSIHYPRSTPEMWEGLFQKAKDGGLDVIQTYVFWNGHEPTPGNYNFEGRYDLVKFIKTAQKAGLFVHLRIGPYICGEWNFGGFPVWLKYVPGISFRTDNEPFKTAMQGFTEKIVGMMKSEELFASQGGPIILSQASIENEYGPEGKSFGAAGKSYSNWAAKMAVGLDTGVPWVMCKQDDAPDPVINACNGFYCDAFSPNKPYKPTMWTEAWTGWFTEFGGTIRKRPVEDLSFAVARFVQKGGSFINYYMYHGGTNFGRTAGGPFITTSYDYDAPLDEYGLAREPKYGHLKELHRAVKLCEPALVSVDPAVTTLGSMQEAHVFRSPSSCAAFLANYNSNSHANVVFNNEHYSLPPWSISILPDCKTVVFNTATVGVQTSQMQMWADGESSMMWERYDEEVGSLAAAPLLTTTGLLEQLNVTRDSSDYLWYITSVDVSPSEKFLQGGEPLSLTVQSAGHALHIFINGQLQGSASGTREAKKFSYKGNANLRAGTNKIALLSIACGLPNVGVHYETWNTGIVGPVVLHGLDVGSRDLTWQTWSYQVGLKGEQMNLNSLEGASSVEWMQGSLLAQAPLSWYRAYFDTPTGDEPLALDMGSMGKGQIWINGQSIGRYSTSYASGDCKACSYAGSYRAPKCQAGCGQPTQRWYHVPKSWLQPSRNLLVVFEELGGDSSKISLVKRSVSSVCADVSEYHTNIKNWQIENAGEVEFHRPKVHLRCAPGQTISAIKFASFGTPLGTCGNFQQGDCHSTKSHAVLEKNCIGQQRCAVTISPDNFGGDPCPKEMKKVAVEAVCSPGT

SEQ ID NO: 7879 - protein, 849 aa, Festuca arundinacea
  misc_feature (390)..(390): Xaa can be any naturally occurring amino acid
  misc_feature (396)..(396): Xaa can be any naturally occurring amino acid
  misc_feature (482)..(482): Xaa can be any naturally occurring amino acid
  misc_feature (501)..(501): Xaa can be any naturally occurring amino acid
  misc_feature (533)..(533): Xaa can be any naturally occurring amino acid
MARRWPAAALLLLLLLGLALAAAAVLVAAVEGAVTYDKKAVVINGERKILFSGSIHYPRSTPEMWEGLIQKAKDGGLDVIQTYVFWNGHEPTQGNYNFEGRYDLVKFIKTAHKAGLFVHLRIGPYICGEWNFGGFPVWLKYVPGISFRTDNEPFKTAMQGFTEKIVGMMKSEELFASQGGPIILSQIENEYGPEEKEFGAAGKSYSNWAAKMAVGLDTGVPWVMCKQDDAPDPVINACNGFYCDAFSPNQPYKPTMWTEAWTGWFTEFGGTIRKRPVEDLSFAVARFVQKGGSFINYYMYHGGTNFGRTAGGPFITTSYDYDAPLDEYGLAREPKYGHLKELHRAIKLCEPALVSVDPAVTSLGSMQEAHVYRSPSGCAAFLANYNSNSXAKVVFXNEHYSLPPWSISILPDCKTVVFNTATVGVQTSQMQMWADGASTMMWERYDEEVGSLAAAPVLTTTGLLEQLNVTRDTSDYLWYITXVDINPSETFLQGGKPLSLXVQSAGHALHIFINGQLQGSASGTREDKRISYXGDVNLRAGSNKIALLSVACGLPNIGVHYETWNTGVNGPVVLHRLDEGSRDLTWQTWSYQVGLKGEQMNLNSLEGAGSVEWMQGSLVAQNQMPLTWYRAYFETPSGDESLALDMGSMGKGQIWINGQSIGRYSTAYATGDCKDCSYTGSFRATRCQSGCGQPTQRWYHVPKSWLQPTRNLLVVFEEVGGDSSKISLAKRSVSSVCADVSEFHPDIKNWQTENAGEPAPEFHKPKVHLRCAVGQSISAIKFASFGTPLGTCGNFEQGECHATKSHTVLEKCIGKQRCAVTISPDNFGGDPCPNMMKRVVVEAVCSPGT

SEQ ID NO: 7880 - protein, 786 aa, Triticum aestivum
  misc_feature (214)..(214): Xaa can be any naturally occurring amino acid
  misc_feature (230)..(230): Xaa can be any naturally occurring amino acid
  misc_feature (234)..(234): Xaa can be any naturally occurring amino acid
MWEGLIQKAKDGGLDVIQTYVFWNGHEPTPGNYNFEGRYDLVKFIKTAQKAGLFVHLRIGPYICGEWNFGGFPVWLKYVPGISFRTDNEPFKAAMQGFTEKIVGMMKSEELFASQGGPIILSQIENEYGPEEKEFGAAGKSYSDWAAKMAVGLDTGVPWVMCKQEDAPDPVINACNGFYCDAFTPNTPSKPTMWTEAWTGWFTEFGGTIRKRPXEDLSFAVARFVQKGGXFINXYMYHGGTNFGRTAGGPFITTSYDYDAPLDEYGLAREPKYGHLKELHRAIKLCEPALVSVDPTVTSLGSMQEAHVYRSPSGCAAFLANYNSNSHAKVVFDNEHYSLPPWSISILPDCKTVVYNTATVGVQTSQMQMWSDGASSMMWERYDEEVGSLAAAPLLTTTGLLEQLNVTRDTSDYLWYMTSVDVSPSEKFLQGGKPLSLSVQSAGHALHIFINGQLQGSASGTREDKRISYKGNVNLRAGTNKISLLSVACGLPNIGVHYETWNTGVNGPVVLHGLDEGSRDLTWQTWTYQVGLKGEQMNLNSLEGASSVEWMQGSLIAQNQMPLAWYRAYFDTPSGDEPLALDMGSMGKGQIWINGQSIGRYSLAYATGDCKDYSYTGSFRATKCQAGCGQPTQRWYHVPKSWLQPSRNLLVVFEELGGDTSKISLVKRSVSSVCADVSEFHPSIKNWQTESSGEAKPELHRSKVHLRCAPGQSISAIKFASFGTPSGTCGSFEQGECHSTKSQTVLEKCIGKQRCAVAISPDNFGGDPCPDVMKRVAVEAVCSPGT

SEQ ID NO: 7881 - protein, 354 aa, Raphanus sativus
  misc_feature (65)..(65): Xaa can be any naturally occurring amino acid
MEVSGVVLRQIPCVSSSVTDGRYSGLRFSGNTRTTTVGFRTRRFRGITCNNEFSDKGHMSYYSGXTTRCGGEGKDKVKVMEKEKKKEMKKKAKVLKALSKNLNMFSSIGFGLDPEAGLVAEIQNKTISEATEILVKQLDQLKAEEKLLKKQRKEEKAKAKALKMMTEMDSESSSSSSESSDSDCGKGKVVDMSSFRNKAILEPLRPESGVATLPRIQEDSCKNTGEALKLALLQSAAASTAFPSVVNPGLPLKTVEAVPVVGLPSKRIEVCMGGKCKKSGGAVLLDEFQKAMTGMEGFAVACKCMGKCRDGPNVRVVNETDAVMTDSVRTPSKTVCVGVGLQDVETIVTSFFGE

SEQ ID NO: 7882 - protein, 355 aa, Raphanus sativus
  misc_feature (60)..(60): Xaa can be any naturally occurring amino acid
  misc_feature (277)..(277): Xaa can be any naturally occurring amino acid
MEVSGVVLRQIPCVSSSVTDGRYSGLRFSGNTRTTTVGFRTRRFRGITCNNEFADKGHMXYYSGTTTTRCGGEGKDKVKVMEKEKKKEMKKKAKVLKALSKNLNMFSSIGFGLDPEAGLVSEIQNKTISEATEILVKQLDQLKSEEKLLKKQRKEEKAKAKALKMMTEMDSESSSSSSESSDSDCGKGKVVDMSSFRNKAILEPLQPESGVATLPRIQEDSCKNTGEALKLALLQSAAASTAFPSVVNPGLPLKTVEAVPVVGLPSKRIEVCMGGKXKKSGGAVLLDEFQKAMTGMEGSAVACKCMGKCRDGPNVRVVNETDAVMTDSVRTPSKTVCVGVGLQDVETIVTSFFGE

SEQ ID NO: 7883 - protein, 360 aa, Arabidopsis lyrata
MEVSGVVLRQIPCVSSGSVACLRLVSEFSGNTRTVGFRTKKFRGIVCNNEFADKGHMSYYIEPTRCGEEKEKVKVMEKEKKALKKKEKVLKSLSKNLNMFSSIGFGLDPEAGLVGEIQTKTISEATEILVKQLEQLKAEEKLLKKQRKEEKAKAKAMKKMTEMDSESSSSSESSDSDRDKGKVVDMSSLRNKTKPVLEPLQPEATVATLPRIQEDAQSCKNTSEALQIALQTSTVFPSMPNPVQTLKTVEAVSVVGLPLKRVEVCMGGKCKKSGGALLLDEFQRAMTGFQGSAVACKCMGKCRDGPNVRVVNETDSVMTDSVRTPSKTVCVGVGLQDVETIVTSFFDEECSREGLGYVSH

SEQ ID NO: 7884 - protein, 51 aa, Brassica juncea
MSTTFPLSQSLSLDSEEEDDSESISVIIFMALAFAFSSFLCFFKSFSSAFN

SEQ ID NO: 7885 - protein, 377 aa, Thellungiella halophila
MEVSGVVLRQIPSVSGAVADGRYSGLRSVSKFSGNSRTVSFQTRKFHGVMCNNEFADKEHMNYYFKPTRCGGEKEKVKLMEKEKKALKKKAKVLKSLSKNLNMFSSIGFGLNPEAGLVSEIQNKSISEATEILVKQLEQLKAEEKLLKKQRKEEKAKAKAMKMTTDMDSESSSSSSESSDSDCGKGKVVDMNTLRNKEKPILEPLQPESTLATLPRIQETLISNKKLEEDAQITGEALQLALLQSAAASTVFPLMANPGQRLKTVEAVSVVGLPLKRVEVCMGGKCKKSGGAVLLNEFQRAMTGMEGSAVACKCMGKCRDGPNVRVVNETYDSMMTDSVKTPSKTVCVGVGLQDVETIVTSFFGEESSREGLGYVSY

SEQ ID NO: 7886 - protein, 360 aa, Arabidopsis thaliana
MEVSGVVLRQIPCVSSGSVAGLRLVSEFSGNTRTVGFRTRRFRGIVCNNEFADKGHVNYYIEPTRCGEEKEKVKVMEKEKKALKKKAKVLKSLSKNLDMFSSIGFGLDPEAGLVGEIQTKTISEATEILVKQLEQLKAEEKILKKQRKEEKAKAKAMKKMTEMDSESSSSSESSDSDCDKGKVVDMSSLRNKAKPVLEPLQPEATVATLPRIQEDAISCKNTSEALQIALQTSTIFPSMANPGQTLKTVEAVSVVGLPLNRVEVCMGGKCKRSGGALLLDEFQRAMTGFEGSAVACKCMGKCRDGPNVRVVKETDAVMTDSVRTPSKTLCVGVGLQDVETIVTSFFDEECSREGLGSVSY

SEQ ID NO: 7887 - protein, 166 aa, Raphanus sativus
MALRMWASSTANALKLSSSASKSHLLPAFSISRCFSSVLEGLKYANSHEWVKHDGSVATIGITDHAQDHLGEVVFVELPEEKSSVSKEKNFGAVESVKATSEILSPISGEVVEVNTKLTDSPGLINSSPYEDGWMIKVKPSNPAELETLMGSKEYTKFCEEEDAAH

SEQ ID NO: 7888 - protein, 166 aa, Brassica juncea
MALRMWASSTANALKLSSSASKSHLLPAFSISRCFSSVLEGLKYANSHEWVKHDGSVATIGITDHAQDHLGEVVFVELPEEKSSVSKEKNFGAVESVKATSEILSPISGEVIEVNTKLTDSPGLINSSPYEGGWMIKVKPSNPAELETLMGPKEYTKFCEEEDAAH

SEQ ID NO: 7889 - protein, 163 aa, Brassica juncea
ALRMWASSTANALKLSSSASKSHLLPAFSISRCFSSEGLKYATSHEWVKHDGSVATIGITDHAQDHLGEVVFVELPEEKSSVSKEKNFGAVESVKATSEILSPISGEVIEVNTKLTDSPGLINSSPYEDGWMIKVKPSNPAELETLMGPKEYTKFCEEEDAAH

SEQ ID NO: 7890 - protein, 166 aa, Thellungiella halophila
MALRMWASSTANALKLSSSASKSHLLPAFSISRCFSSVLEGLKYANSHEWVKHEGSVATIGITDHAQGHLGEVVFVELPEEKSAVSKEKNFGAVESVKATSEILSPISGEVIEVNTKLTDSPGLINSSPYEDGWMIKVKPSNPAELESLMGPKEYTKFCEEEDAAH

SEQ ID NO: 7891 - protein, 166 aa, Brassica juncea
MALRMWASSTANALKLSSSASKSHLLPAFSISRCFSSVLEGLKYANSHEWVKHEGSVATIGISDHAQDHLGEVVFVELPEEKSSVTKEKNFGAVESVKATSEIISPISGEVIEVNTKLADSPGLINSSPYEDGWMIKVKPSNPAELESLMGSKEYTKFCEEEDAAH

SEQ ID NO: 7892 - protein, 166 aa, Brassica napus
MALRMWASSTANALKLSSSASKSHLLPAFSISRCFSSVLEGLKYANSHEWVKHEGSVATIGISDHAQDHLGEVVFVELPEEKSSVSKEKNFGAVESVKATSEILSPISGEVIEVNTKLADSPGLINSSPYEEGWMIKVKPSNPAELESLMGPKEYTKFCEEEDAAH

SEQ ID NO: 7893 - protein, 166 aa, Unknown
  Sequence found in Organisms: Brassica napus, Zea mays, Brassica juncea
MALRMWASSTANALKLSSSASKSHLLPAFSISRCFSSVLEGLKYANSHEWVKHEGSVATIGISDHAQDHLGEVVFVELPEEKSSVSKEKNFGAVESVKATSEIISPISGEVIEVNTKLADSPGLINSSPYEEGWMIKVKPSNPAELESLMGPKEYTKFCEEEDAAH

SEQ ID NO: 7894 - protein, 166 aa, Brassica oleracea
MALRMWASSTANALKLSSSASKSHLLPAFSISRCFSSVLEGLKYANSHEWVKHEGSVATIGISDHAQDHLGEVVFVELPEEKSSVTKEKNFGAVESVKATSEIISPISGEVIEVNTKLADSPGLINSSPYEDGWMIKVKPSNPAELESLMGPKEYTKFCEEEDAAH

SEQ ID NO: 7895 - protein, 166 aa, Arabidopsis thaliana
MALRMWASSTANALKLSSSASKSHLLPAFSISRCFSSVLEGLKYANSHEWVKHEGSVATIGITDHAQDHLGEVVFVELPEANSSVSKEKSFGAVESVKATSEILSPISGEVIEVNTKLTESPGLINSSPYEDGWMIKVKPSSPAELEALMGPKEYTKFCEEEDAAH

SEQ ID NO: 7896 - protein, 166 aa, Brassica oleracea
  misc_feature (107)..(107): Xaa can be any naturally occurring amino acid
MALRMWASSTANALKLSSSASKSHLLPAFSISRCFSSVLEGLKYANSHEWVKHEGSVATIGISDHAQDHLGEVVFVELPEEKSSVSKEKNFGAVESVKATSEIISPXSGEVIEVNTKLADSPGLINSSPYEEGWMIKVKPSNPAELESLMGPKEYTKFCEEEDAAH

SEQ ID NO: 7897 - protein, 166 aa, Unknown
  Sequence found in Organisms: Brassica napus, Brassica rapa
MALRMWASSTANALKLSSSASRSHLLPAFSISRCFSSVLEGLKYANSHEWVKHEGSVATIGISDHAQDHLGEVVFVELPEEKSSVTKEKNFGAVESVKATSEIISPISGEVIEVNTKLADSPGLINSSPYEDGWMIKVKPSNPAELESLMGPKEYTKFCEEEDAAH

SEQ ID NO: 7898 - protein, 166 aa, Brassica rapa
MALRMWASSTANALKLSSSASKSHLLPAFSISRCFSSVLEGLKYANSHEWVKHEGSVATIGISDHAQDHLGEVVFVELPEEKSSVSKGKNFGAVESVKATSEIISPISGEVIEVNTKLADSPGLINSSPYEEGWMIKVKPSNPAELESLMGPKEYTKFCEEEDAAH

SEQ ID NO: 7899 - protein, 166 aa, Brassica napus
MALRMWASSTANALKLSSSASKSHLLPAFSISRCFSSVLEGLKYANSHEWVKHEGSVATIGISDHAQDHLGEVVFVELPEEKSSVTKEKNFGAVESVKATSEIISPISGEVIEVNTKLADSPGLINSSPYEDGWMMKVKPSNPAELESLMGPKEYTKFCEEEDAAH

SEQ ID NO: 7900 - protein, 166 aa, Raphanus sativus
MALRMWASSTANALKLSSSASKSHLLPAFSISRCFSSVLEGLKYANSHEWVKHEGSVATIGISDHAQDHLGEVVFVELPEEKSSVSKEKNFGAVESVKATSEIISPISGEVIEVNTKLADSPGLINSSPYEEGWMIKVKPSNPAELESLMGPKEYTKFCEDEDAAH

SEQ ID NO: 7901 - protein, 166 aa, Raphanus sativus
MALRMWASSTANALKLSSSASKSHLLPAFSISRCFSSVLEGLKYANSHEWVKHEGSVATIGISDHAQDHLGEVVFVELPEEKSSVTKEKNFGAVESVKATSEIISPISGEVIEVNTKLADSPGLINSSPYEDGWMIKVKPSNPAELESLMGPTEYTKFCEEEDAAH

SEQ ID NO: 7902 - protein, 166 aa, Arabidopsis lyrata
MALRMWASSTANALKLSSSASKSHLLPAFSISRCFSSVLEGLKYANSHEWVKHDGSVATIGITDHAQDHLGEVVFVELPEANSSVSKEKSFGAVESVKATSEILSPISGEVIEVNTKLTESPGLINSSPYEEGWMIKVKPSSPAELEALMGPKEYTKFCEDEDAAH

SEQ ID NO: 7903 - protein, 166 aa, Raphanus sativus
MALRMWASSTANALKLSSSASKSHLLPAFSISRCFSSVLEGLKYANSHEWVKHEGSVATIGISDHAQDHLGEVVFVELPEEKSSVTKEKNFGAVESVKATSEIISPISGEVIEVNTKLADSPGLINSSPYEDGWMIKVKPSNPAELESLMGPTEYTKFCEDEDAAH

SEQ ID NO: 7904 - protein, 166 aa, Raphanus sativus
  misc_feature (104)..(104): Xaa can be any naturally occurring amino acid
  misc_feature (117)..(117): Xaa can be any naturally occurring amino acid
MALRMWASSTATALKLSSSASKSHLLPAFSISRCFSSVLEGLKYANSHEWVKHEGSVATIGISDHAQDHLGEVVFVELPEEKSSVSKEKNFGAVESVKATSEIXSPISGEVIEVNTXLADSPGLINSSPYEEGWMIKVKPSNPAELESLMGPKEYTKFCEDEDAAH

SEQ ID NO: 7905 - protein, 166 aa, Brassica juncea
MALRMWASSTANALKLSSSVSKSQLSPSFSISRCFSSVLDGLKYANSHEWVKHEGSVATIGITDHAQDHLGEVVFVELPEENGSVSKEKSFGAVESVKATSEILSPISGEVIEVNKKLTEAPGLINSSPYEDGWMIKVKPSNPSELESLMGSKEYIKFCEEEDAAH

SEQ ID NO: 7906 - protein, 166 aa, Brassica napus
MALRMWASSTANALKLSSSVSKSQLSPAFSISRCFSSVLEGLKYANSHEWVKHEGSVATIGITDHAQDHLGEVVFVELPEENGSVRKEKSFGAVESVKATSEILSPISGEVIEVNKTLSEAPGLINSSPYEDGWMIKVKPSNPSELESLMGSKEYTKFCEEEDAAH

SEQ ID NO: 7907 - protein, 158 aa, Brassica juncea
STANALKLSSSASKSHLLPAFSVSRCFSSVLEGLKYANSHEWVKHEGSVATIGISDHAQDHLGEVVFVELPEEKSAVTKEKNFGAVESVKATSEIISPISGEVIEVNTKLADSPGLINSSPYEDGWMIKVKPSNPAELESLMGSKEYTKFCEEEDAAH

SEQ ID NO: 7908 - protein, 165 aa, Arabidopsis lyrata
MALRMWASSTANALKLSSSVSKSHLSPFSISRCFSTVLEGLKYANSHEWVKHEGSVATIGITAHAQDHLGEVVFVELPEENTSATKEKSFGAVESVKATSEILSPISGEIIEVNKKLTESPGLINSSPYEDGWMIKVKPSSPAELESLMGPKEYTKFCEEEDAAH

SEQ ID NO: 7909 - protein, 158 aa, Brassica juncea
STANALKLSSSASRSHLLPAFSISRCFSSVLEGLKYANSHEWVKHEGSVATIGISDHAQDHLGEVVFVELPEEKSSVTKEKNFGAVESVKATSEIISPISGEVIEVNTKLADSPGLINSSPYEDGWMIKVKPSNPTELESLMGPKEYTKFCEEEDAAH

SEQ ID NO: 7910 - protein, 165 aa, Arabidopsis thaliana
MALRMWASSTANALKLSSSVSKSHLSPFSFSRCFSTVLEGLKYANSHEWVKHEGSVATIGITAHAQDHLGEVVFVELPEDNTSVSKEKSFGAVESVKATSEILSPISGEIIEVNKKLTESPGLINSSPYEDGWMIKVKPSSPAELESLMGPKEYTKFCEEEDAAH

SEQ ID NO: 7911 - protein, 166 aa, Thellungiella halophila
MALRMWASSTANILKLSSSVSKSHLSPAFSICRCLSSVLEGLKYANSHEWVKHEGSVATIGITDHAQGHLGEVVFVELPEENGSVSKEKSFGAVESVKATSEILSPISGEVIEVNKKLTESPGLINSSPYEDGWMIKVRPSSPAELESLMGPKEYTKFCVEEDAAH

SEQ ID NO: 7912 - protein, 51 aa, Brassica napus
ESVAAVRPVVRVDQRVRGRVGDMALRMWASSTANALKLSWVAFETHKVAAF

SEQ ID NO: 7913 - protein, 165 aa, Cleome spinosa
MALRMWASSTANALKLSRASKANLSPAFSISRCFSTVLEGLKYASSHEWVKHEGSVAIIGISDHAQDHLGEVVFVELPEENASVNKDKAFGAVESVKATSEIISPISGEVIEINTKLADSPGLINSSPYEDGWMIKVKPSSPSELESLMGPKEYTKFCEEEDASH

SEQ ID NO: 7914 - protein, 161 aa, Cleome spinosa
MWASSTANALKLSCASKSSLSPAFSISRCFSTVLEGLKYANSHEWVKHEGSVATIGITDHAQDHLGEVVFVELPDEKSSVNKDKPFGAVESVKATSEIISPISGEVIEINTKLGDSPGLINSSPYEDGWMIKVKPSSPSELESLMGPKEYTKFCEEEDASH

SEQ ID NO: 7915 - protein, 173 aa, Raphanus sativus
TEQEKQRNKTKMWASSTANALKLSSSVSKSQLSPSFSISRCFSSVLEGLKYANSHEWVKHEGSVAIIGITDHAQDHLGEVVFVELPEENGSVSKEKSFGAVESVKATSEILSPISGEVTEVNKKLIEAPGLINSSPYEDGWMIKVKPSNPSELESLMGSKEYTKFCEEEDAAH

SEQ ID NO: 7916 - protein, 165 aa, Quercus alba
MALRMWASSTANALRISCASKAHLSPAFSLSRCFSSVLDGLKYASSHEWVKHEGPVATIGITDHAQDHLGEVVFVELPEPGGSVSQGSSFGAVESVKATSDINSPISGEVVEVNSKLTESPGLINKSPYEDGWMIKLKPSNPSELESLMGSKEYTKFCEEEDAAH

SEQ ID NO: 7917 - protein, 164 aa, Prunus persica
MALRMWASSTANALRISSASKAHLSPAFSFSRCFSSVLEGLKYASSHEWVKHEGSVATIGITDHAQDHLGEVVFVELPEAGRSVSAGVGFGAVESVKATSDINSPISGDVVEVNSKLTESPGLINSSPYEDGWMIKIKPSNPSELESLLGAKEYTKFCEEEDAA

SEQ ID NO: 7918 - protein, 167 aa, Antirrhinum majus
MALRMWASSTANALKLSTNASKSSLLAPAFSLSRCFSTVLEGAKYATSHEWVKHEGAVATVGITDHAQDHLGEVVFVELPEAGKSVTKGESFGAVESVKATSDVNSPISGEVVEVNTKLSETPGLINSGPYEDGWMIKVKPSDPSELESLMGSKEYTKFCEEEDAAH

SEQ ID NO: 7919 - protein, 165 aa, Vitis vinifera
MALRMWASSTANALRVSCASKAHVSPAFSLSRCFSSVLDGLKYATSHEWVKHEGSVATIGITDHAQDHLGEVVFVELPEPGGSVSKGNGFGAVESVKATSDVNSPISGEVVEVNSKLSEAPGLINSSPYEDGWMIKVKPGNPSELESLMGPKEYTKFCEEEDAAH

SEQ ID NO: 7920 - protein, 165 aa, Pisum sativum
MALRMWASSTANALKLSSSSRLHLSPTFSISRCFSNVLDGLKYAPSHEWVKHEGSVATIGITDHAQDHLGEVVFVELPEPGVSVTKGKGFGAVESVKATSDVNSPISGEVIEVNTGLTGKPGLINSSPYEDGWMIKIKPTSPDELESLLGAKEYTKFCEEEDAAH

SEQ ID NO: 7921 - protein, 178 aa, Raphanus sativus
KTQSNRSKRSKETKTKMWASSTANALKLSSSVSKSQLSPYFSISRCFSSVLEGLKYANSHEWVKHEGSVATIGITDHAQDHLGEVVFVELPEENGSVSKEKSFGAVESVKATSEILSPISGEVIEVNKKLTEAPGLINSSPYEDGWMIKVKPSNPSELESLMGSKEYTKFCEEEDAAH

SEQ ID NO: 7922 - protein, 161 aa, Triphysaria pusilla
MALRLWASSTANALKLSASASPAFTLSRSFSTVLEGLKYATSHEWVKHDGAVATIGITDHAQDHLGEVVFVELPDAGKPVSQANSFGAVESVKATSDINSPISGEVVEVNTKLSDSPGLINSSPYEDGWMIKVKPSNPSELESLMGAKEYTKFCEEEDASH

SEQ ID NO: 7923 - protein, 165 aa, Mimulus guttatus
MALRMWASSTANALRLSSSSSSRFAPAFSLSRTFSTVLEGFKYATSHEWVKHDGSIATIGITDHAQDHLGEVVFVELPEGGKAVAQASSFGAVESVKATSDINSPISGEVVEVNTKLTESPGLINSSPYEDGWMIKVKPSNPSELESLMGPKEYTKFCEDEDASH

SEQ ID NO: 7924 - protein, 165 aa, Cucumis sativus
MALRMWASSTANALKLSSSSKTHLSPSFSLSRCFSTVLDGLKYASSHEWVKHEGSVATVGITDHAQDHLGEVVFVDLPESGSSVSQGKSFGAVESVKATSDINSPISGEIVEVNPQLKESPGLINSSPYEGGWMIKVKPSNPGELDSLLGPKEYTKFCEEEDAAH

SEQ ID NO: 7925 - protein, 165 aa, Malus domestica
MALRMWASSTANALRISTASKSHLSPAFSLSRCFSTVLDGLKYASSHEWVKHEGSVATIGITDHAQDHLGEVVFVELPEAGRSVSQGGSFGAVESVKATSDVNSPISGEVVEVNSKLTESPGLINSSPYEDGWMIKIKPSSPSELESLLGPKEYTKFCEEENAAH

SEQ ID NO: 7926 - protein, 165 aa, Phaseolus coccineus
MALRMWASSTANALKLSSASRPHLLPPFSFSRCLSTVLDGLKYAESHEWVKHEGSVATIGITDHAQDHLGEVVFVELPEPGGAVSKNSGFGAVESVKATSDINSPISGEIVEVNTKLTETPGLVNSSPYEDGWMIKVKPSDPSELESLLGPKEYTKFCEEEDASH

SEQ ID NO: 7927 - protein, 165 aa, Castanea mollissima
MALRMWASSTANALRISCASKAHLSPAFSLSRCFSSVLDGLKYASSHEWVKHEGPVATIGITDHAQDHLGEVVFVELPEPGGSVSQGGSFGAVESVKATSDVNSPISGEIVEVNSKLAESPGLINKSPYEDGWMIKLKPSNPSELESLMGSKEYTKFCEEEDAAH

SEQ ID NO: 7928 - protein, 166 aa, Trifolium pratense
MALRMWASSTANALKLSSSASRLHLSPPFSISRCFSSVLDGLKYTSSHEWVKHEGSVATIGISDHAQDHLGEVVFVELPEPGGSVTKGNGFGAVESVKATSDVNSPISGEIVEVNDKLTGKPGLINSSPYEDGWMIKIKPSDPSELESLLGAKEYTKFCEEEDAAH

SEQ ID NO: 7929 - protein, 166 aa, Lotus japonicus
MALRMWASSTANALKLSSSASRLHLSPPFSLSRCFSSVLDGLKYASSHEWVKHEGSVATIGITDHAQDHLGEVVFVELPESGKPVTKGDGFGAVESVKATSDINSPISGEIIEVNTKLSEQPGLINTSPYEDGWMIKVKPSSPSELDSLLGPQEYTKFCEEEDAAH

SEQ ID NO: 7930 - protein, 166 aa, Medicago truncatula
MALRMWASSTANALKLSSSSSRLHLSPPFSISRCFSTVLDGLKYASSHEWVKHEGSVATIGITDHAQDHLGEVVFVELPEPGGSVTKGNGFGAVESVKATSDVNSPISGEIVEVNDKLTGKPGLINSSPYEDGWMIKIKPSDPSELESLLGAKEYTKFCEEEDAAH

SEQ ID NO: 7931 - protein, 166 aa, Mimulus guttatus
MALRMWASSTANALRLSSSSSSSRFAPAFSLSRTFSTVLEGFKYATSHEWVKHDGSIATIGITDHAQDHLGEVVFVELPDGGKAVEQASSFGAVESVKATSDINSPISGEVVEVNTKLTESPGLINSSPYEDGWMIKVKPSNPSELESLMGPKEYTKFCEDEDASH

SEQ ID NO: 7932 - protein, 165 aa, Mimulus guttatus
MALRMWASSTANALRLSSSSSSRFAPAFSLSRTFSTVLEGFKYATSHEWVKHDGSIATIGITDHAQDHLGEVVFVELPDGGKAVEQASSFGAVESVKATSDINSPISGEVVEVNTKLTESPGLINSSPYEDGWMIKVKPSNPSELESLMGPKEYTKFCEDEDASH

SEQ ID NO: 7933 - protein, 165 aa, Cucumis melo
MALRMWASSTANALKLSSSSKTHLSPSFSLSRCFSTVLDGLKYASSHEWVKHEGSVATVGITDHAQDHLGEVVFVDLPESGSSVSQGKSFGAVESVKATSDINSPISGEIVEVNPQLKETPGLINSSPYEGGWMIKVKPSNPGELDSLLGPKEYTKFCEEEDAAH

SEQ ID NO: 7934 - protein, 161 aa, Triphysaria pusilla
MALRVWASSTANALKLSASASPAFTLSRSFSTVLEGLKYATSHEWVKHDGAMATIGITDHAQDHLGEVVFVELPDAGKPVSQANSFGAVESVKATSDINSPISGEVVEVNTKLSDSPGLINSSPYEDGWMIKVKSSNPSELESLMGTKEYTKFCEEEDASH

SEQ ID NO: 7935 - protein, 161 aa, Triphysaria pusilla
MALRLWASSTANALKLSSSASPAFTLSRTFSTVLEGYKYATSHEWVKHDGSVATIGITDHAQDHLGELVFVELPEPGKSVSQGSSFGAVESVKATSDVNSPISGEVIEFNTNLSDSPGLINSGPYEDGWMIKVKPSNPSELDSLMDAKEYTKFCEEEDASH

SEQ ID NO: 7936 - protein, 165 aa, Malus domestica
MALSLWASSTANALRISTASKSHLSPAFSLSRCFSTVLDGLKYASSHEWVKHEGSVATIGITDHAQDHLGEVVFVELPESGRSVSQGGSFGAVESVKATSDVNSPISGQVVEVNSKLTESPGLINSSPYEDGWMIKIKPSSPSELESLLGPKEYTKFCEEEDAAH

SEQ ID NO: 7937 - protein, 165 aa, Cucumis melo
  misc_feature (63)..(63): Xaa can be any naturally occurring amino acid
MALRMWASSTANALKLSSSSKTHLSPSFSLSRCFSTVLDGLKYASSHEWVKHEGSVATVGITXHAQDHLGEVVFVDLPESGSSVSQGKSFGAVESVKATSDINSPISGEIVEVNPQLKETPGLINSSPYEGGWMIKVKPSNPGELDSLLGPKEYTKFCEEEDAAH

SEQ ID NO: 7938 - protein, 165 aa, Glycine max
MALRMWASSTANALKLSSVSRPHLLPPFSFSRCLSSVLDGLKYADSHEWVKHEGSVATIGITDHAQDHLGEVVYVELPEPGGTVSKKSGFGAVESVKATSDINSPISGEIVEVNKKLTETPGLVNSSPYEDGWMIKVKPSDPSELDSLMGPKEYTKFCEEEDASH

SEQ ID NO: 7939 - protein, 165 aa, Juglans hindsii x Juglans regia
MALRMWASSTANAFRFSYASKSHLSPAFSLSRCFSTVLDGLKYASSHEWVKHEGAVATIGITDHAQDHLGEVVFVELPEAGGSISQGGSFGAVESVKATSDVNSPISGEIVEVNTKLTESPGLINSKPYEDGWMIKVKPSNPSELEAMMGPKEYTKFCEEEDASH

SEQ ID NO: 7940 - protein, 166 aa, Catharanthus roseus
MALRMWASSTANALKVSTSSRALFSPAAFSLSRCFSSVLDGLKYAPSHEWVKHDGPVATIGITDHAQDHLGEVVFVDLPEAGGSVDKGKSFGNVESVKATSDINSPISGEIVEVNAKLSETPGLINTSPYEDGWMIKVKPSSPAELESLMGAKEYTKFCEEEDAAH

SEQ ID NO: 7941 - protein, 167 aa, Carica papaya
MALRIWASSTANALKLSSAASKSHHLSSPFSLSRCFSTVLEGLKYAASHEWVKHEGSVATIGITHHAQEHLGEVVFVELPETGTSVSKGSSFGAVESVKATSDVNSPVSGEVVEVNQTLTGSPALINSSPYEEGWMIKVKPNNPSELESLMDSKAYTKFCEEEDAAH

SEQ ID NO: 7942 - protein, 141 aa, Brassica juncea
LPAFSISRCFSSVLEGLKYANSHEWVKHEGSVATIGISDHAQDHLGEVVFVELPEEKSSVSKEKNFGAVESVKATSEIISPISGEVIEVNTKLADSPGLINSSPYEEGWMIKVKPSNPAELESLMGPKEYTKFCEEEDAAH

SEQ ID NO: 7943 - protein, 165 aa, Ricinus communis
MALRMWASSTANTLKISVACKAQLSPSYSLSRCFSSVLDGLKYATSHEWVKHEGSVATIGITDHAQDHLGEVVFVDLPEAGTSVTQGKSFGAVESVKATSDVNSPISGEVVEVNTKLTEGPGSINSSPYEEGWMIKVKPNNPSELESLMGPKEYTKFCEEEDAAH

SEQ ID NO: 7944 - protein, 163 aa, Eucalyptus gunnii
MALRMWASSTANALRLSSKASLSPAFSLHRCFSSVLDGLKYAPSHEWVKHEGPVASVGITDHAQDHLGEVVFVDLPEPGGSVSKGGSFGAVESVKATSDINSPISGEIVEVNTKLTETPGLVNSSPYEDGWMIKVKPSDPSELGSLMGPKEYTKFCEEEDAAH

SEQ ID NO: 7945 - protein, 165 aa, Cajanus cajan
MALRMWASSTANALKLSSASRPHLFPSFSFSRCLSTVLDGLKYADSHEWVKHEGSVATIGITDHAQDHLGEVVYVELPEPGGAVSKKSGFGAVESVKATSDINSPISGEIVEVNKKLTETPGLVNSSPYEDGWMIKVKPSDPSELHSLMGPKEYTKFCEEEDASH

SEQ ID NO: 7946 - protein, 163 aa, Salvia sclarea
MALRMWASSTANALRLSTCASKSPAFSLSRAFSTVLDDLKYASSHEWVKHDGGVATIGITDHAQEHLGEVVFVELPESGKEVKQGSGFGAVESVKATSDVNSPISGEVVEVNTKLTDSPGLINTSPYEDGWMIKVKPTNPSDLGNLMGSKEYTKFCEEEDAAH

SEQ ID NO: 7947 - protein, 166 aa, Fragaria vesca
MALRMWASSTANALRISGGASKAQLSPAFSLSRCFSTVLEGLKYASSHEWVKHEGSVATIGITDHAQDHLGEVVFVELPEPGTVVSQSSSFGNVESVKATSDVNSPISGEVVEVNPKLSETPGLINTSPYEDGWMIKVKPSNPSELESLLGAKEYTKFCEEEDAAH

SEQ ID NO: 7948 - protein, 165 aa, Juglans hindsii x Juglans regia
MALRMWASSTANALRISRASSSHLSPAFSLSRCFSTVLDGLKYASSHEWVKPEGAVATIGITDHAQDHLGEVVFVELPEAGGSVSQGSSFGAVESVKATSDVNSPISGEIVEVNTKLTETPGLINSSPYEGGWMIKVKPSSPSELESLLGPKEYTKFCEEEDAAH

SEQ ID NO: 7949 - protein, 165 aa, Gossypium hirsutum
MALRMWASSTANALKISCSSKPNVSLAFSLSRCFSTVLDGLKYANSHEWVKHEGPVATIGITDHAQDHLGEVVFVELPEPGGSVSQGKGFGAVESVKATSDINSPISGEVVEVNSKLSETPGLINSSPYADGWMIKVKPSSPSELESLMGPKEYTKFCEEEDASH

SEQ ID NO: 7950 - protein, 609 aa, Brassica juncea
KYIVIAPWAVHSTYRFVTDDPVDLGYSLVLPFLLFRILHNQVWISLSRYYTTKGKRRILDKGIDFNQVDRETNWDDQILFNGLLFYIGIMLLPQAKQLPLWRTDGVLMAAMLHAGPVEFLYYWLHKALHHHFLYSRYHSHHHSSIVTEPITSVIHPFAEHIAYFILFAIPLLTTLLTRTASIASFAGYVIYIDFMNNMGHCNFELVPKRLFHLFPPLKFLCYTPSFHSLHHTQFRTNYSLFMPLYDYIYGTMDESSDTLYEKSLERGEDRVDVVHLTHLTTPESIYHLRIGLASFASHPFSYRWFMRLLWPFTSLSMLFTLFYASLFVAERNSFEKLNLQSWIIPRYNLQYLLKWRKDAINNMIEKAILEANKKGVKVLSLGLMNQGEELNRNGEVYIHKHPEMKVRVVDGSRLTAAVVINSLPKSTTKVVMTGNLTKVAYTIASALCQRGVEVLTLLPEEYEKLRSLVPQECRDRLVLLTSETLASNKVWLMGEGTTREEQEMATKGTLFIPFSQFPLKQLRRDCIYHTPPALIIPKSLVNIHSCENWLPRKAMSATRVAGILHALEGWEMHECGTSNILLSDLDQVWEACLTHGFQPLLLPHHFQYP

SEQ ID NO: 7951 - protein, 625 aa, Arabidopsis thaliana
MATKPGVLTDWPWTPLGSFKYIVIAPWAVHSTYRFVTDDPEKRDLGYFLVFPFLLFRILHNQVWISLSRYYTSSGKRRIVDKGIDFNQVDRETNWDDQILFNGVLFYIGINLLPEAKQLPWWRTDGVLMAALIHTGPVEFLYYWLHKALHHHFLYSRYHSHHHSSIVTEPITSVIHPFAEHIAYFILFAIPLLTTLLTKTASIISFAGYIIYIDFMNNMGHCNFELIPKRLFHLFPPLKFLCYTPSYHSLHHTQFRTNYSLFMPLYDYIYGTMDESTDTLYEKTLERGDDIVDVVHLTHLTTPESIYHLRIGLASFASYPFAYRWFMRLLWPFTSLSMIFTLFYARLFVAERNSFNKLNLQSWVIPRYNLQYLLKWRKEAINNMIEKAILEADKKGVKVLSLGLMNQGEELNRNGEVYIHNHPDMKVRLVDGSRLAAAVVINSVPKATTSVVMTGNLTKVAYTIASALCQRGVQVSTLRLDEYEKIRSCVPQECRDHLVYLTSEALSSNKVWLVGEGTTREEQEKATKGTLFIPFSQFPLKQLRRDCIYHTTPALIVPKSLVNVHSCENWLPRKAMSATRVAGILHALEGWEMHECGTSLLLSDLDQVWEACLSHGFQPLLLPHH

SEQ ID NO: 7952 - protein, 579 aa, Brassica rapa
  misc_feature (10)..(10): Xaa can be any naturally occurring amino acid
  misc_feature (17)..(18): Xaa can be any naturally occurring amino acid
  misc_feature (53)..(53): Xaa can be any naturally occurring amino acid
  misc_feature (64)..(64): Xaa can be any naturally occurring amino acid
HSNSTMGGPXHIQVCDXXSGGSRILPRITLLALQNSSQPGLDLSFPYYTTREXAHPDKGIMLLXQAKQLPCETDGVLMAAMLHAGPVEFLYYWLHKALHHHFLYSRYHSHHHSSIVTEPITSVIHPFAEHIAYFILFAIPLLTTLLTRTASIASFAGYVIYIDFMNNMGHCNFELVPKRLFHLFPPLKFLCYTPSFHSLHHTQFRTNYSLFMPLYDYIYGTMDETSDTLYEKSLERGEDRVDVVHLTHLTTPESIYHLRIGLASFASYPFSYRWFMRLLWPFTSLSMLFTLFYASLFVSERNSFEKLNLQSWIIPRYNLQYLLKWRKDAINNMIEKAILEANKKGVKVLSLGLMNQGEELNRNGEVYIHKHPEMKVRVVDGSRLTAAVVINSLPKSTTKIVMTGNLTKVAYTIASALCQRGVEVLTLLPEEYEKLRSLVPQECRDRLVLLTSETLASNKVWLMGEGTTREEQEMATKGTLFIPFSQFPLKQLRRDCIYHTPPALIIPKSLVNIHSCENWLPRKAMSATRVAGILHALEGWEMHECGTSNILLSDLDQVWEACLTHGFQPLLLPHHFQYP

SEQ ID NO: 7953 - protein, 170 aa, Raphanus sativus
MARFTVLIAAVVLAIVVAVPEVTAKKYTVGENKFWNPNINYTIWAQGKHFYLGDWLYFVFDRNQHNILEVNKTDYENCNADHPLVNWTRGAGRDIVTLNVTKHYYLLDGRGGCYGGMKLAVKVEKLPPPPKAAPVKSIGSVSMATGVAQFVIPFALFSVSTVWDAILRMW

SEQ ID NO: 7954 - protein, 162 aa, Raphanus sativus
MARLTVLIAAVVLAYVVVMPVPGVTAKKYTVGDNKFWNPNINYTIWAQGKHFYLGDWLYFVFDRNQHNILEVNKTDYENCNSDHPLVNWTRGAGRDVVPLNVTKHYYLLDGKGGCYGGMKLAVKVEKLPPPPKSAPVKNIGSVSVVTGLAQFMIPFALLRMW

SEQ ID NO: 7955 - protein, 172 aa, Arabidopsis thaliana
MARFTVLITAVVLAFLMAAPMPGVTAKKYTVGENKFWNPNINYTIWAQGKHFYLGDWLYFVFDRNQHNILEVNKTDYEGCIADHPIRNWTRGAGRDIVTLNQTKHYYLLDGKGGCYGGMKLSVKVEKLPPPPKSAPVKNIGSVSMVTGLAQFMIPVSLFAFPAMWDVISRMW

SEQ ID NO: 7956 - protein, 172 aa, Arabidopsis lyrata
MARLTVLIVAVALAFLVAAPMPEVTAKKYTVGENKFWNPNINYTIWAQGKHFYLGDWLYFVYDRNQHNILEVNKTDYEGCIADHPIRNWTRGAGRDIVTLNETKHYYLLDGKGGCYGGMKLAVKVEKLPPPPKSAPVKNIGSASMVTGFAQFMIPVSLFAFPAMWDVISRMW

SEQ ID NO: 7957 - protein, 220 aa, Hordeum vulgare
LYPGATESPELRWALIRKVYVILCLQLLLTAVVAVVVVRVRAIPRFFVSSYAGLGLYVFLLILPFIVLCPLSIYRQKHPVNLLLLGVFTVAISFSVGLTCAFNSGKVILEAGILTVVVVLSLTVYTFWAAKRGKDFSFLAPFLFASLSMLLVFGLIQIFFPLGKLSHTIYGALAALIFSGYIVYDTNNIIKRYTYDDYVWAAVSLYLDIINLFLGLLTLF

SEQ ID NO: 7958 - protein, 272 aa, Triticum aestivum
HEAPHSPSATPKKTLHPEASSSPGEMKGGDIEAGGDVEAGTAAPKGAPYPGTTESPELRWALIRKVYVVLCLQLLLTAVVAVVFVKVRSIPHFFASSYVGLGLYIFILIFPFIVMCPLHFYRQKHPVNLLLLGVFTVAISFSVGLTCAFTSGKVILEAGILTIVVVLSLTAYTFWAARRGKDFSFLGPFLFACLMILLVFGFIQIFFPLGKLSHMIYGALAALIFIGYIVYDTGNIIKRYKYDEYVWAAVTLYLDIINLFLGLMTLFRAGDS

SEQ ID NO: 7959 - protein, 250 aa, Triticum aestivum
PAKTLPPEATPGKMKGGGDIEAGTAAPKGTTESPELRWALIRKIYVVLCLQLLLTAAVAVVFVKVSSIPRFFVSSYAGLGLYVFILVFPFVVLCPLHIYRQKHPINLLLLGVFTVAISFSVGLTCAFTSGKVILQAGILTIVVVLSLTAYTFWAARRGKDFSFLGPFLFASLMILLVFAFIQIFFPLGKLSHMIYGALAALIFSGYIVYDTGSIIKRYKYDEYVWAAVTLYLDIINLFLGLLTLFRACDN

SEQ ID NO: 7960 - protein, 234 aa, Triticum aestivum
GGDVEAGTAEPKGTTESPELRWALIRKIYVVLCLQLLLTAAVAVVFVRVRAIPHFFVSSYAGLGLYIFILIFPFIVTFPLHFYRQKHPVNLLLLGVFTVAISFSVGLTCAFTSGKVILEAGILTIVVVLSLTAYTFWAARRGKDFSFLGPFLFASLMILLVFGFIQIFFPLGKLSHMIYGALAALIFSGYIVYDTGSIIKRYKYDKYVWAAVTLYLDIINLFLGLLTLFRACDN

SEQ ID NO: 7961 - protein, 177 aa, Avena sativa
MAAADGEKKMITLKSSDGEEFEVEEAVAMESQTIRHMIEDDCADNGIPLPNVNSKILSKVIEYCNKHVQAAKPVAEGGAPAPAPAAADSSSAAPAPAEDLKNWDAEFVKVDQATLFDLILAANYLNIKGLLDLTCQTVADMIKGKTPEEIRKTFNIKNDFTAEEEEEIRRENQWAFE

SEQ ID NO: 7962 - protein, 128 aa, Saccharum officinarum
MASEGDNKKMITLRSSDNEEFEVEEAVAMESQTIRHMIEDDCADNGIPLPNVNSKILSKVIEYCNKHVHAAAKPADAADRRRRRGRRGPQELGRGVRQGRPGYALRPHPGCQLSEHQGIAGPHLPDGG

SEQ ID NO: 7963 - protein, 159 aa, Cenchrus ciliaris
MITLRSSDGEEFEVEEAVAMESQTIRHMIEDDCADNGIPLPNVNAKILSKVIEYCNKHVHAAKPADDAAPAAADASAGAEDLKNWDAEFVKVDQATLFDLILAANYLNIKGLLDLTCQTVADMIKGKTPEEIRKTFNIKNDFTPEEEEEIRRENQWAFE

SEQ ID NO: 7964 - protein, 173 aa, Oryza sativa
MAAEGEKKMITLKSSDGEEFEVEEAVAMESQTIRHMIEDDCADNGIPLPNVNSKILSKVIEYCNKHVHAAAAAASKAADDAASAAAAVPPPSGEDLKNWDADFVKVDQATLFDLILAANYLNIKGLLDLTCQTVADMIKGKTPEEIRKTFNIKNDFTPEEEEEIRRENQWAFE

SEQ ID NO: 7965 - protein, 176 aa, Zea mays
MAAEGEKKMITLKSSDGEEFEVEEAVAMESQTIRHMIEDDCADNGIPLPNVNSKILSKVIEYCNKHVHAAAAAAAASKAGSDDVGAASANSTAASGEDLKNWDADFVKVDQATLFDLILAANYLNIKGLLDLTCQTVADMIKGKTPEEIRKTFNIKNDFTPEEEEEIRRENQWAFE

SEQ ID NO: 7966 - protein, 176 aa, Unknown
  Sequence found in Organisms: Sorghum bicolor, Saccharum officinarum
MAAEGEKKMITLKSSDGEEFEVEEAVAMESQTIRHMIEDDCADNGIPLPNVNSKILSKVIEYCNKHVHAAAAAAAASKAGSDDVGAAAANSTAASGEDLKNWDADFVKVDQATLFDLILAANYLNIKGLLDLTCQTVADMIKGKTPEEIRKTFNIKNDFTPEEEEEIRRENQWAFE

SEQ ID NO: 7967 - protein, 178 aa, Brachypodium distachyon
MAAEGEKKMITLKSSDGEEFEVEETVAMESQTIRHMIEDDCADNGIPLPNVNSKILSKVIEYCNKHVHATAAAKAANPSDGDANPAAANNSSTTAAPGEDLKNWDADFVKVDQATLFDLILAANYLNIKGLLDLTCQTVADMIKGKTPEEIRKTFNIKNDFTPEEEEEIRRENQWAFE

SEQ ID NO: 7968 - protein, 191 aa, Arabidopsis lyrata
MTQSQTNDGAGAGAVTTVEAVPPQPQPQPQQQSNEMVLHTGSLSFSSHMSREDEEMTRSALSAFRAKEDEIEKRRMEVRERIQAQLGRVEQETKRLSTIREELESMADPMRKEVSVVRKKIDSVNKELKPLGSTVQKKEREYKEALDTFNEKNREKVQLITKLMEMEQLVGESEKLRMIKLEELSKSIETV

SEQ ID NO: 7969 - protein, 190 aa, Brassica rapa
MTQTNAGASTGAAAAATTELPPPQPQPQTQRSEMVLHTGSLSFSSHMSREDEEMTRSALSAFRAKEDEIEKRRAEVRERIQAQLGRVEEETRRLSTLREEIESMADPMRKEVSVVRKKIDSVNKELKPLGSTVQKKEREYKEALDTFNEKNREKVQLITKLMEMEQLVGESEKLRMKKLEELSKSIEETV

SEQ ID NO: 7970 - protein, 191 aa, Brassica napus
MTQTNAGASTGAAAAATTTELPPPQPQPQTQRSEMVLHTGSLSFSSHMSREDEEMTRSALSAFRAKEDEIEKRRAEVRERIQAQLGRVEEETRRLSTLREEIESMADPMRKEVSVVRKKIDSVNKELKPLGSTVQKKEREYKEALDTFNEKNREKVQLITKLMEMEQLVGESEKLRMKKLEELSKSIEETV

SEQ ID NO: 7971 - protein, 179 aa, Brassica rapa
MTQTNAGAGTGAAATTEPPQSNEMVLHTGSLSFSSHMSKEDEEMTRSALSAFKAKEDEIDKRRMEVRERIQAQLGRVEEETRRLSTIREELESMADPMRKEVSMVRKKIDSVNKELKPLGSTVQKKEREYKEALDTFNEKNREKVQLITKLMEMEQLVGESEKLRMKKLEELSKSIETV

SEQ ID NO: 7972 - protein, 179 aa, Brassica oleracea
  misc_feature (120)..(120): Xaa can be any naturally occurring amino acid
MTQTNAGAGTGAAATTEPPQSDEMVLHTGSLSFSSHMSKEDEEMTRSALSAFKAKEDEIDKRRMEVRERIQAQLGRVEEETRRLSTIREELESMADPMRKEVSMVRKKIDSVNKELKPLXSTVQKKEREYKEALDTFNEKNREKVQLITKLMEMEQLVGESEKLRMKKLEELSKSIESV

SEQ ID NO: 7973 - protein, 125 aa, Brassica juncea
MAGRLSGVASRIMGGNGIVARSNASSLRQRAGMGLPVGKHIVPDKPLSVNDELMWDNGTAFPEPCIDRIADTVGKYEALGWLCGGLGFFATLGMLAVVNDKASKVPFTPRVYPYDNLRVELGGEP

SEQ ID NO: 7974 - protein, 125 aa, Brassica juncea
MAGRLSGVASRIMGGNGIVARSGASSLRQRAGMGLPVGKHIVPDKPLSVNDELMWDNGTAFPEPCIDRIADTVGKYEALGWLCGGLGFFATLGMLAVVNDKASKVPFTPRVYPYDNLRVELGGDP

SEQ ID NO: 7975 - protein, 125 aa, Theobroma cacao
MAGRLSNVASRIMGGNGIVSRSVASSLRLRSGMGLPVGKHIVPDKPLPVNDELIWDNGTSFPEPCIDRIADTVGKYEALAWMCGGLSFFASLGLLAWWNDKASKIPFTPKVYPYDNLRVELGGEP

SEQ ID NO: 7976 - protein, 125 aa, Catharanthus roseus
  misc_feature (95)..(95): Xaa can be any naturally occurring amino acid
MAARLSHVASRIMGGNGIVSRSVDSSLRLRSGMGLPVGKHIVPDKPLPVNDELVWDNGTPFPEPCIDRIADTVGKYEALAWWASGLGFFVTLGLXARWNDKASKIPYVPKVYPYDNLREELGGEP

SEQ ID NO: 7977 - protein, 389 aa, Brassica napus
MANGAGRVDLDGKPIKPMTICMIGAGGFIGSHLCEKLLTETPHKVLALDVYNDKIKHLLEPDTAEWKDRIQFHRINIKHDSRLEGLVKMADLTINLAAICTPADYNTRPLDTIYSNFIDALPVVKYCSENNKRLIHFSTCEIYGKTIGSFLPKDHPLREDPSFYVLKEDVSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTEVYAKVSGEGAIESPTVDVSSKEFYGEGYDDSDKRIPDMTIINRQLGWNPKTSLWDLLESTLTYQHRTYAEAVKKATSKPVAS

SEQ ID NO: 7978 - protein, 389 aa, Raphanus sativus
MANGAGRVDLDGRPIKPMTICMIGAGGFIGSHLCEKLLNETPHKVLALDVYNDKIKHLLEQDTVEWKDRIQFHRINIKHDSRLEGLVKMADLTINLAAICTPADYNTRPLDTIYSNFIDALPVVKYCSENNKRLIHFSTCEVYGKTIGSFLPKDHPLREDPSFYVLKEDVSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTEVYAKVSGEGAIESPTVDVSSKEFYGEGYDDSDKRIPDMTIINRQLGWNPKTSLWDLLESTLTYQHRTYAEAVKKATSKPVAS

SEQ ID NO: 7979 - protein, 389 aa, Brassica napus
MANGAVRLDLDGKPIKPLTICMIGAGGFIGSHLCEKLLTETPHKVLALDVYNDKIKHLLEPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYSKVSGETAIESPTIDVSSKEFYGEGYDDSDKRIPDMTIINRQLGWNPKTSLWDLLESTLTYQHRTYAEAVKKATSKPVAS

SEQ ID NO: 7980 - protein, 389 aa, Arabidopsis thaliana
MANGANRVDLDGKPIQPLTICMIGAGGFIGSHLCEKLLTETPHKVLALDVYNDKIKHLLEPDTVEWSGRIQFHRINIKHDSRLEGLVKMADLIINLAAICTPADYNTRPLDTIYSNFIDALPVVKYCSENNKRLIHFSTCEVYGKTIGSFLPKDHPLRDDPAFYVLKEDISPCIFGSIEKQRWSYACAKQLIERLVYAEGAENGLEFTIVRPFNWIGPRMDFIPGIDGPSEGVPRVLACFSNNLLRREPLKLVDGGESQRTFVYINDAIEAVLLMIENPERANGHIFNVGNPNNEVTVRQLAEMMTEVYAKVSGEGAIESPTVDVSSKEFYGEGYDDSDKRIPDMTIINRQLGWNPKTSLWDLLESTLTYQHRTYAEAVKKATSKPVAS

SEQ ID NO: 7981 - protein, 390 aa, Brassica napus
MANNGAVRLDLDGKPIKPITICMIGAGGFIGSHLCEKLLNETPHKVLALDVYNDKIKHLLEPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYSKVSGETAIESPTVDVSSKEFYGEGYDDSDKRIPDMTIINRQLGWNPKTSLWDLLESTLTYQHRTYAEAVKKATSKPVAS

SEQ ID NO: 7982 - protein, 390 aa, Brassica napus
MANNGAVRLDLDGKPIKPLTICMIGAGGFIGSHLCEKLLNETPHKVLALDVYNDKIKHLLEPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYSKVSGETAIESPTVDVSSKEFYGEGYDDSDKRIPDMTIINRQLGWNPKTSLWDLLESTLTYQHRTYAEAVKKATSKPVAS

SEQ ID NO: 7983 - protein, 390 aa, Brassica napus
MANNGAVRLDLDGKPIKPLTICMIGAGGFIGSHLCEKLLTETPHKVLALDVYNDKIKHLLDPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYSKVSGETAIESPTIDVSSKEFYGEGYDDSDKRIPDMTIINRQLGWNPKTSLWDLLESTLTYQHRTYAEAVKKATSKPVAS

SEQ ID NO: 7984 - protein, 390 aa, Unknown
  Sequence found in Organisms: Brassica napus, Brassica rapa
MANNGAVRLDLDGKPIKPLTICMIGAGGFIGSHLCEKLLNETPHKVLALDVYNDKIKHLLEPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYSKVSGETAIESPTIDVSSKEFYGEGYDDSDKRIPDMTIINRQLGWNPKTSLWDLLESTLTYQHRTYAEAVKKATSKPVAS

SEQ ID NO: 7985 - protein, 389 aa, Brassica rapa
MANGAVRLDLDGKPIKPLTICMIGAGGFIGSHLCEKLLAETPHKVLALDVYNDKIKHLLDPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYSKVSGETAIESPTIDVSSKEFYGEGYDDSDKRIPDMTIINRQLGWNPKTSLWDLLESTLTYQHRTYAEAVKKATSKPVAS

SEQ ID NO: 7986 - protein, 389 aa, Raphanus sativus
MANAAVRLDLDGKPIKPITICMIGAGGFIGSHLCEKLLNETPHKVLALDVYNDKIKHLLEPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPEFYVLKEDASPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYSKVSGETAIESPTIDVSSKEFYGEGYDDSDKRIPDMTIINRQLGWNPKTSLWDLLESTLTYQHRTYAEAVKKATSKPVAS

SEQ ID NO: 7987 - protein, 387 aa, Brassica juncea
NGAVRLDLDGKPIKPLTICMIGAGGFIGSHLCEKLLNETPHKVLALDVYNDKIKHLLEPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYSKVSGETAIESPTIDVSSKEFYGEGYDDSDKRIPDMTIINRQLGWNPKTSLWDLLESTLTYQHRTYAEAVKKATSKPVAS

SEQ ID NO: 7988 - protein, 390 aa, Brassica oleracea
  misc_feature (238)..(238): Xaa can be any naturally occurring amino acid
  misc_feature (308)..(308): Xaa can be any naturally occurring amino acid
  misc_feature (317)..(317): Xaa can be any naturally occurring amino acid
MANNGAVRLDLDGKPIKPITICMIGAGGFIGSHLCEKLLNETPHKVLALDVYNDKIKHLLEPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVXACFSNNLLRREPLKLVDGGESQRTFIYIKDAIEAVLLMIENPERANGHIFNVGNPNNEVTVRQLAEMMTXVYSKVSGEXAIESPTVDVSSKEFYGEGYDDSDKRIPDMTIINRQLGWNPKTSLWDLLESTLTYQHRTYAEAVKKATSKPVAS

SEQ ID NO: 7989 - protein, 387 aa, Brassica napus
NGAVRLDLDGKPIKPITICMIGAGGFIGSHLCEKLLNETPHKVLALDVYNDKIKHLLEPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYSKVSGETAIESPTIDVSSKEFYGEGYDDSDKRIPDMTIINRQLGWNPKTSLWDLLESTLTYQHRTYAEAVKKATSKPVAS

SEQ ID NO: 7990 - protein, 386 aa, Brassica napus
GAVRLDLDGKPIKPLTICMIGAGGFIGSHLCEKLLTETPHKVLALDVYNDKIKHLLEPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYSKVSGETAIESPTIDVSSKEFYGEGYDDSDKRIPDMTIINRQLGWNPKTSLWDLLESTLTYQHRTYAEAVKKATSKPVAS

SEQ ID NO: 7991 - protein, 390 aa, Raphanus sativus
  misc_feature (35)..(35): Xaa can be any naturally occurring amino acid
  misc_feature (40)..(40): Xaa can be any naturally occurring amino acid
MANGAAVRLDLDGKPIKPLTICMIGAGGFIGSHLXEKLLXETPHKVLALDVYNDKIKHLLEPDTSEWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYSKVSGETAIESPTIDVSSKEFYGEGYDDSDKRIPDMTIINRQLGWNPKTSLWDLLESTLTYQHRTYAEAVKKATSKPVAS

SEQ ID NO: 7992 - protein, 389 aa, Brassica napus
MANGADRLDLDGRPIKPLTICMIGAGGFIGSHLCEKLMNETPHKVLALDVYNDKIKHLLEPDTSQWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTQVYSKVSGETAIESPTVDVSSKEFYGEGYDDSDKRIPDMTIINRQLGWNPKTSLWDLLESTLTYQHRTYAEAVKKATSKPVAS

SEQ ID NO: 7993 - protein, 389 aa, Arabidopsis thaliana
MANGADRLDLDGKPIKPMTICMIGAGGFIGSHLCEKLMTETPHKVLALDVYNDKIKHLLEPDTVQWAGRIQFHRINIKHDSRLEGLIKMADLTINLAAICTPADYNTRPLDTIYSNFIDALPVVKYCSENNKRLIHFSTCEVYGKTIGSFLPKDHPLRQDPEFYVLKEDISPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTEVYAKVSGETAIESPTIDVSSKEFYGEGYDDSDKRIPDMTIINRQLGWNPKTSLWDLLESTLTYQHTTYAEAIKKATSKPVAS

SEQ ID NO: 7994 - protein, 389 aa, Raphanus sativus
MANGADRLDLDGRPIKPMTICMIGAGGFIGSHLCEKLMNETPHKVLALDVYNDKIKHLLEPDTSQWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTEVYSKVSGETAIESPTIDVSSKEFYGEGYDDSDKRIPDMTIINRQLGWNPKTSLWDLLESTLTYQHRTYAEAVKKATSKPVAS

SEQ ID NO: 7995 - protein, 389 aa, Brassica napus
MANGADRLDLDGRPIKPLTICMIGAGGFIGSHLCEKLMNETPHKVLALDVYNDKIKHLLEPGTSQWAERIQFHRINIKHDSRLEGLVKMADLTINLAAICTPADYNTRPLDTIYSNFIDALPVVKYCSENNKRLIHFSTCEVYGKTIGSFLPKDHPLRQDPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTQVYSKVSGEAAIESPTVDVSSKEFYGEGYDDSDKRIPDMTIINRQLGWNPKTSLWDLLESTLTYQHRTYAEAVKKATSKPVAS

SEQ ID NO: 7996 - protein, 387 aa, Brassica rapa
NGADRLDLDGRPIKPLTICMIGAGGFIGSHLCEKLMNETPHKVLALDVYNDKIKHLLEPDTSQWAERIQFHRINIKHDSRLEGLVKMADLTINLAAICTPADYNTRPLDTIYSNFIDALPVVKYCSENNKRLIHFSTCEVYGKTIGSFLPKDHPLRQVPDFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTQVYSKVSGETAIESPTVDVSSKEFYGEGYDDSDKRIPDMTIINRQLGWNPKTSLWDLLESTLTYQHRTYAEAVKKATSKPVAS

SEQ ID NO: 7997 - protein, 389 aa, Cleome gynandra
MENGAGRVDLDGRSIKPITICMIGAGGFIGSHLCEKLMSETPHKVLALDVYSDKIKHLLEPDTLPWADRIQFHRINIKHDSRLEGLIKMADLTINLAAICTPADYNTRPLDTIYSNFIDALPVVKYCSENNKRLIHFSTCEVYGKTIGSFLPKDHPLRQDPDYYVLKEDTSPCIFGSIEKQRWSYACAKQLIERLIYAEGAENGLQFTIVRPFNWIGPRMDFIPGIDGPSEGVPRVLACFSNNLLRGEPLKLVDGGQSQRTFIYIKDAIEAVLLMIENPDRANGHIFNVGNPDNEVTVRQLAEMMTKVYSKVSGEAALESPTIDVSSKEFYGEGYDDSDKRIPDMTIINRQLGWNPKTSLWDLLESTLTYQHRTYAEAVKKAVSKPIAS

SEQ ID NO: 7998 - protein, 386 aa, Gossypium hirsutum
MATRTDLDGRPIKPMTICMIGAGGFIGSHLCEKLMSETPHKVLALDVYNDKIKHLLEPDSLPWAGRIQFHRLNIKHDSRLEGLIKMADLVINLAAICTPADYNTRPLDTIYSNFIDALPVVKYCSENNKRLIHFSTCEVYGKTIGSFLPKDSPLRQDPAYYVLKEDTSPCIFGSIEKQRWSYACAKQLIERLIYAEGAENGLEFTIVRPFNWIGPRMDFIPGIDGPSEGVPRVLACFSNNLLRREPLKLVDGGESQRTFIYIKDAIEAVLLMIENPDRANGHIFNVGNPNNEVTVRQLAEMMTKVYAKVSGETVLESPTVDVSSKEFYGEGYDDSDKRIPDMTIINKQLGWNPKTSLWDLLESTLTYQHRTYAEAIKKSIAKPSAS

SEQ ID NO: 7999 - protein, 387 aa, Mimulus guttatus
MATGRVDLDGNPIKPMTICMIGAGGFIGSHLCEKLLTETPHKVLAVDVYNDKIKHLLEPSTAEWADRIQFHRLNIKNDSRLEGLIRMADLTINLAAICTPADYNTRPLDTIYSNFIDALPVVKYCSENNKRLIHFSTCEVYGKTIGCFLPKDSPLRQDPEYYVLKEDTSPCIFGPIDKQRWSYACAKQLIERLVYAEGAENGLEFTIVRPFNWIGPRMDFIPGIDGPSEGVPRVLACFSNNLLRGEPLKLVDGGESQRTFVYIKDAIEAVLLMIENPARANGHIFNVGNPDNEVTVRQLAEMMTKVYSKVSGEPSLDSPTIDVSSKEFYGEGYDDSDKRIPDMTIINRQLGWNPKTSLWDLLESTLTYQHRTYAEAVKKATSQAAAN

SEQ ID NO: 8000 - protein, 386 aa, Gossypium hirsutum
MATRTDLDGRPIKPLTICMIGAGGFIGSHLCEKLMSETPHKVLALDVYNDKIKHLLEPDSLPWAGRIQFHRLNIKHDSRLEGLIKMADLTINLAAICTPADYNTRPLDTIYSNFIDALPVVKYCSENNKRLIHFSTCEVYGKTIGSFLPKDSPLRQDPAYYVLKEDTSPCIFGSIEKQRWSYACAKQLIERLIYAEGAETGLEFTIVRPFNWIGPRMDFIPGIDGPSEGVPRVLACFSNNLLRREPLKLVDGGESQRTFIYIKDAIEAVLLMIENPDRANGHIFNVGNPNNEVTVRQLAEMMTKVYAKVSGETVLESPTVDVSSKEFYGEGYDDSDKRIPDMTIINKQLGWNPKTSLWDLLESTLTYQHRTYAEAIKKSIAKPSAS

SEQ ID NO: 8001 - protein, 386 aa, Solanum lycopersicum
MAGRVDLDGNPIKQITICMIGAGGFIGSHLCEKLLSETPHKVLAVDVYSDKIKHLLEPATVTWADRIQFHRINIKNDSRLEGLIKMADLTINLAAICTPADYNTRPLDTIYSNFIDALPVVKYCSENGKRLIHFSTCEVYGKTIGAFLPKDSPLRQDPAYYVLKEDTSPCIFGPIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPARANGHIFNVGNPNNEVTVRQLAEMMTKVYAKVSGESSIETPTIDVSSKEFYGEGYDDSDKRIPDMTIINRQLGWNPKTSLWDLLESTLTYQHRTYAEAVKQAMSKTTAN

SEQ ID NO: 8002 - protein, 386 aa, Solanum tuberosum
MAGRVDLDGNPIKQITICMIGAGGFIGSHLCEKLLSETPHKVLAVDVYSDKIKHLLEPATVTWADRIQFHRINIKNDSRLEGLIKMADLTINLAAICTPADYNTRPLDTIYSNFIDALPVVKYCSENGKRLIHFSTCEVYGKTIGAFLPKDSPLRQDPAYYVLKEDTSPCIFGPIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPARANGHIFNVGNPNNEVTVRQLAEMMTKVYSKVSGESSIETPTIDVSSKEFYGEGYDDSDKRIPDMTIINRQLGWNPKTSLWDLLESTLTYQHRTYAEAVKQAMSKTTAN

SEQ ID NO: 8003 - protein, 386 aa, Solanum phureja
MAGRVDLDSNPIKQITICMIGAGGFIGSHLCEKLLSETPHKVLAVDVYSDKIKHLLEPATVTWADRIQFHRINIKNDSRLEGLIKMADLTINLAAICTPADYNTRPLDTIYSNFIDALPVVKYCSENGKRLIHFSTCEVYGKTIGAFLPKDSPLRQDPAYYVLKEDTSPCIFGPIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPARANGHIFNVGNPNNEVTVRQLAEMMTKVYSKVSGESSIEIPTIDVSSKEFYGEGYDDSDKRIPDMTIINRQLGWNPKTSLWDLLESTLTYQHRTYAEAVKQAMSKTTAN

SEQ ID NO: 8004 - protein, 390 aa, Citrus sinensis
MAGASVRLDLDGRPIKPMTICMIGAGGFIGSHLCEKILLETPHKILALDVYNDKIKHLLEPESQTGADRIQFHRLNIKHDSRLEGLIKMADLTINLAAICTPADYNTRPLDTIYSNFIDALPVVKYCSENNKRLIHFSTCEVYGKTIGSFLPKDSPLRQDPAYYVLKEDASPCIFGSIEKQRWSYACAKQLIERLIYAEGAENGLEFTIVRPFNWIGPRMDFIPGIDGPSEGVPRVLACFSNNLLRRQPLKLVDGGQSQRTFIYIKDAIEAVLLMIENPARANGHIFNVGNPHNEVTVRQLAEMMTEVYAKVSGEAALEEPTVDVSSKEFYGEGYDDSDKRIPDMTIINQQLGWNPKTSLWDLLESTLTYQHRTYAEAIKQAVAKPVASS

SEQ ID NO: 8005 - protein, 386 aa, Gossypium hirsutum
MATRMDLDGRPIKPMTICMIGAGGFIGSHLCEKLMAETPHKVLALDVYSDKIKHLLEPDSLPWAGRIVFHRLNIKHDSRLEGLIKMADLTINLAAICTPADYNTRPLDTIYSNFIDALPVVKYCSENNKRLIHFSTCEVYGKTIGSFLPKDSPLRKDPAYYVLKEDTSPCIFGSIEKQRWSYACAKQLIERLIYAEGAENGLDFTIVRPFNWIGPRMDFIPGIDGPSESVPRVLACFSNNLLRREPLKLVDGGESQRTFVYIKDAIEAVLLMIENPDRANGHIFNVGNPNNEVTVRQLAEMMTKVYAKVSGEPSLESPTIDVSSKEFYGEGYDDSDKRIPDMTIINRQLGWNPKTTLWDLLESTLTYQHRTYAEAIKKSMVKPIAS

SEQ ID NO: 8006 - protein, 387 aa, Cajanus cajan
MASGRVDLDGRPIKPMTICMIGAGGFIGSHLCEKLMSETPHTVLALDVYSDKIKHLLEPHTLPWAGRIQFHRLNIKHDSRLEGLIKIADLTINLAAICTPADYNTRPLDTIYSNFIDALPVVKYCSENNKRLIHFSTCEVYGKTVGSFLPKDSPLRKDPAYYVLKEDESPCIFGSIEKQRWSYACAKQLIERLIYAEGAENGLEFTIVRPFNWIGPRMDFIPGVDGPSEGVPRVLACFSNNLLRGEPLKLVDGGQSQRTFVYIKDAIEAVLLMIENPARANGHIFNVGNPNNEVTVRQLAEMMTQVYSKVSGEASLEKPTIDVSSKEFYGEGYDDSDKRIPDMTIINRQLGWNPKTSLWDLLESTLTYQHRTYAEAIKKVIAKPVAS

SEQ ID NO: 8007 - protein, 389 aa, Actinidia deliciosa
MASTARVDLDGNPIKAMTICMIGAGGFIGSHLCEKLMAETPHKVLAVDVYNDKIKHLLEPSSLPWADRIQFHRINIKNDSRLEGLIKMADLTINLAAICTPADYNTRPLDTIYSNFIDALPVVKYCSENNKRLIHFSTCEVYGKTIGSFLPKDHPLRQDPAYFVLKEDESPCIFGSIEKQRWSYACAKQLIERLIYAEGAENGLEFTIVRPFNWIGPRMDFIPGIDGPSEGVPRVLACFSNNLLRREPLKLVDGGESQRTFIYIKDAIEAVLLMIENPARANDHIFNVGNPNNEVTVRQLAEMMTEVYSKVSGEPSLEVPTVYISSKEFYGEGYDDSDKRIPDMTIINKQLGWDPKTSLWDLLESTLTYQHRTYAEAVKQAISKPLTTS

SEQ ID NO: 8008 - protein, 388 aa, Vitis vinifera
MASAARLDLDGNAIKPMTICMIGAGGFIGSHLCEKLMAETMHKVLAVDVYSDKIKHLLEPSTHPWSDRIQFHRINIKHDSRLEGLIKMADLTINLAAICTPADYNTRPLDTIYSNFIDALPVVKYCSENNKRLIHFSTCEVYGKTIGSFLPKDSPLWQDPTYYVLKEDASPCIFGPIEKQRWSYACAKQLIERLIYAEGAENDLEFTIVRPFNWIGPRMDFIPGIDGPSEGVPRVLACFSNNLLRHEPLKLVDGGQSQRTFVYIKDAIEAVLLMIDNPARANGHIFNVGNPNNEVTVRQLAEMMTEVYAKVSGEPSLEVPTVDVSSKEFYGEGYDDSDKRIPDMTIINKQLGWNPKTSLWDLLESTLTYQHRTYAEAIKQAIAKPVAS

SEQ ID NO: 8009 - protein, 386 aa, Lotus japonicus
MAARVDLDGNPIKPLTICMIGAGGFIGSHLCEKLMSETPHKVLALDVYSDKIKHLLEPDTLPWAGRIHFHRLNIKHDSRLEGLIKMSDLTINLAAICTPADYNTRPLDTIYSNFIDALPVAKYCSENNKRLIHFSTCEVYGKTIGSFLPKDSPLRQDPAYYVLKEDESPCIFGSIEKQRWSYACAKQLIERLIYAEGAENGMEFTIVRPFNWIGPRMDFIPGIDGPSEGVPRVLACFSNNLLRREPLKLVDGGESQRTFIYIKDAIEAVLLMIENPARANGHIFNVGNPHNEVTVRQLAEMMTKVYSKVSEEAPLENPAIDVSSKEFYGEGYDDSDKRIPDMTIINKQLGWNPKTSLWDLLESTLTYQHRTYAEAIKKAIAKPVAS

SEQ ID NO: 8010 - protein, 388 aa, Vitis vinifera
MASAARLDLDGNAIKPMTICMIGAGGFIGSHLCEKLMAETMHKVLAVDVYNDKIRHLLEPAAHPWSDRIQFHRINIKHDSRLEGLIKMADLTVNLAAICTPADYNTRPLDTIYSNFIDALPVVKYCSENNKRLIHFSTCEVYGKTIGSFLPKDSPLRQDPAYYLLKEDASPCIFGSIEKQRWSYACAKQLIERLIYAEGAENGLEFTIVRPFNWIGPRMDFIPGIDGPSEGVPRVLACFSNNLLRREPLKLVDGGQSQRTFVYIKDAIEAVLLMIDNPGRANGHIFNVGNPNNEATVKQLAEMMTEVYAKVSGEPSLEVPTVDVSSKEFYGEGYDDSDKRIPDMTIINKQLGWNPKTSLWDLLESTLTYQHRTYAEAIKQAIAKPVAS

SEQ ID NO: 8011 - protein, 389 aa, Populus trichocarpa
MASSVVRVDLDGKPINPLTICMIGAGGFIGSHLCEKILNETQHKILALDVYNDKIKHLLEPDSLPWAGRIQFHRINIKHDSRLEGLIKMSDLTINLAAICTPADYNTRPLDTIYSNFIDALPVAKYCSENGKRLIHFSTCEVYGKTIGSFLPKDSPLRQDPAYYVLKEDASPCIFGSIEKQRWSYACAKQLIERLVYAEGAENGLEFTIVRPFNWIGPRMDFIPGVDGPSEGVPRVLACFSNALLRREPLKLVDGGESQRTFVYIKDAIEAVLLMIENPSRANGHIFNVGNPNNEVTVRQLAEMMTAVYANVSGEPALEEPTVDVSSKEFYGEGYDDSDKRIPDMTIINRQLGWNPKTSLWDLLDSTLTYQHKTYAEAIKKVMSQPTTS

SEQ ID NO: 8012 - protein, 387 aa, Helianthus annuus
MATARVDLDGNTITPMTICMIGAGGFIGSHLCEKLMAETPHTVLAVDVYNDKIKHLLEPDSLPWNGRIQFHRLNIKNDSRLEGLIKCSDLTINLAAICTPADYNTRPLDTIYSNFIDALPVVKYCSENNKRLIHFSTCEVYGKTIGSFLPKDSPLRQDPAYYILKEDTSPCIFGSVEKQRWSYACAKQLIERLIYAEGAENGLEFTIVRPFNWIGPRMDFIPGIDGPSEGVPRVLACFSNNLLRREPLKLVDGGESQRTFIYIKDAIEAVLLMIENPARASGHIFNVGNPNNEVTVRQLAEMMTKVYSKVSGEEAIESPTIDVSSKEFYGEGYDDSDKRIPDMTIINKQLGWNPKTSLWDLLESTLTYQHRTYAEAIKQAIAKPTAN

SEQ ID NO: 8013 - protein, 389 aa, Actinidia deliciosa
  misc_feature (258)..(258): Xaa can be any naturally occurring amino acid
MASAARVDLDGNPIKAMTICMIGAGGFIGSHLCEKLMAETPHKVLAVDVYNDKIKHLLEPASLPWAGRIQFHRINIKNDSRLEGLIKMADLTINLAAICTPADYNTRPLDTIYSNFIDALPVVKYCSENNKRLIHFSTCEVYGKTIGSFLPKDSPMRQDPAYFILKEDASPCIFGSIEKQRWSYACAKQLIERLVYAEGAENGLEFTIVRPFNWIGPRMDFIPGIDGPSEGVPRVLACFSNNLLRGEPLKLVDGGQSXRTFVYIKDAIEAVLLMIENPARANGHIFNVGNPNNEVTVRQLAEMMTEVYSKVSGEPALEVPTIDVSSKEFYGEGYDDSDKRIPDMTIINTQLGWNPRTSLWDLLESTLTYQHRTYAEAIKQAISKPVVSS

SEQ ID NO: 8014 - protein, 148 aa, Cajanus cajan
MARVDLDGKPIKPMTICMIGAGGFIGSHLCEKLMSETPHTVLALDVYSDKIKHLLEPRFPPLGRPHYLPPPQHQARLSPRRPHQDGRSHYKSRCYLHPRGLQHAPSRHHLQQLHRRAPRREILLGEQQAPYPFLHLRSLRKNDRKLSP

SEQ ID NO: 8015 - protein, 386 aa, Gossypium hirsutum
MAARMDLDGRPIKPMTICMIGAGGFIGSHLCEKLMAETPHKVLALDVYNDKIKHLLEPDSLPWAGRIEFHRINIKHDSRLEGLVKMADLTINLAAICTPADYNTRPLDTIYSNFIDALPVVKYCSENSKRLIHFSTCEVYGKTIGSFLPKDSPLRKDPAYYVLKEDTSPCIFGSIEKQRWSYACAKQLIERLIYAEGAESGLDFTIVRPFNWIGPRMDFIPGIDGPSEGVPRVLACFSNNLLRREPLKLVDGGQSQRTFVYIKDAIEAVLLMIENPDRANGHIFNVGNPNNEVTVRQLAEMMTQVYTKVSGEPMLQSPSIDVSSKEFYGEGYDDSDKRIPDMTIINKQLGWNPKTSLWDLLESTLTYQYRTYAEAIKKSMAKPTAS

SEQ ID NO: 8016 - protein, 388 aa, Manihot esculenta
MATGNRVDLDGRPINPITICMIGAGGFIGSHLCEKLLLETPHKILALDVYNDKIKHLLEPASLPWADRIQFHRLNIKHDSRLEGLIKMADLTINLAAICTPADYNTRPLDTIYSNFIDALPVVKYCSENNKRLIHFSTCEVYGKTIGSFLPKDSPLRQDPAYYILKEDTSPCIFGPIEKQRWSYACAKQLIERLIYAEGAENGLEFTIVRPFNWIGPRMDFIPGIDGPSEGVPRVLACFSNALLRSEPLKLVDGGQSQRSFVYIKDAIEAVLLMIENPHRANGHIFNVGNPYNEVTVKQLAEMMTKVYSEVSGEPALEAPTVDVSSKEFYGEGYDDSDKRVPDMTIINRQLGWNPKTSLWDLLESTLTYQHKTYAEAVKKTIAKPTSS

SEQ ID NO: 8017 - protein, 389 aa, Cichorium intybus
MAASSARVDLDGNTINPFTICMIGAGGFIGSHLCEKLLTETPHTVLAVDVYNDKIKHLLEPDSLPWAGRIQFHRLNIKNDSRLEGLIKGSDLTVNLAAICTPADYNTRPLDTIYSNFIDALPVVKYCSENNKRLIHFSTCEVYGKTIGSYLPKDSPLRQDPAYYILKEDTSPCIFGSIEKQRWSYACAKQLIERLIYAEGAENGLEFTIVRPFNWIGPRMDFIPGIDGPSEGVPRVLACFSNNLLRREPLKLVDGGESQRTFVYIKDAIEAVLLMIENPGRANGHIFNVGNPNNEVTVRQLAEMMTKVYSKVSGEDSIETPTIDVSSKEFYGEGYDDSDKRIPDMTIINKQLGWDPKTSLWDLLESTLTYQHRTYAEAVRQSIAKPVAS

SEQ ID NO: 8018 - protein, 389 aa, Populus trichocarpa
MAASTVRINLDGKPINQLTILMIGAGGFIGSHLCEKILQETPHKILALDVYSDKIKHLLEPDSLEWAGRIQFHRINIKHDSRLEGLIKMSDLTINLAAICTPADYNTRPLDTIYSNFIDALPVVKYCSENGKRLIHFSTCEVYGKTIGSFLPKDSPLRQDPAYYVLKEDASPCIFGSIEKQRWSYACAKQLIERLIYAEGAENGLEFTIVRPFNWIGPRMDFIPGIDGPSEGVPRVLACFSNALLRREQLKLVDGGESQRTFVYIKDAIEAVLLMIENPDRANGHIFNVGNPNNEVTVRQLAEMMTAVYANVSGEPALEEPTVDVSSKEFYGEGYDDSDKRIPDMTIINKQLGWNPKTSLWDLLDSTLTYQHKTYAEAVKKVISKPTTS

SEQ ID NO: 8019 - protein, 390 aa, Manihot esculenta
MATAADRVDLDGRPIKPVTICMIGAGGFIGSHLCEKLLMETPHKILALDVYNDKIKHLLEPESQSWGDRIQFHRLNIKNDSRLEGLIKMADLTINLAAICTPADYNTRPLDTIYSNFIDALPVVKYCSENNKRLIHFSTCEVYGKTIGSFLPKDHPLRQDPDYYLLKEDASPCIFGPIEKQRWSYACAKQLIERLIYAEGAENGLEFTIVRPFNWIGPRMDFIPGIDGPSEGVPRVLACFSNALLRHEPLKLVDGGQSQRSFVYIRDAIEAVLLMIENPERANGHIYNVGNPNNEVTVRQLAEMMTEVYSKVSGEPALEVPTVDISSEEFYGEGYDDSDKRVPDMTIINAHLGWNPKTSLWDLLESTLTYQHRTYAEAVKKAISQPSSSS

SEQ ID NO: 8020 - protein, 386 aa, Coffea canephora
MAGRVDLDGNPIKPMTICMIGAGGFIGSHLCEKLMSETEHKVLAVDVYSDKIKHLLEPASLPWAGRIQFHRLNIKNDSRLEGLIKMADLTINLAAICTPADYNTRPLDTIYSNFIDALPVVKYCSENGKRLIHFSTCEVYGKTIGSFLPKDSQLRQDPAYYVLKEDTSPCIFGSIEKQRWSYACAKQLIERLIYAEGAENGLEFTIVRPFNWIGPRMDFIPGIDGPSEGVPRVLACFSNNLLRREPLKLVDGGQSQRTFVYIKDAIEAVHLMIENPARANGQIFNVGNPNNEVTVRQLAEMMTEVYAKVSGEPPLEAATIDVSSKEFYGEGYDDSDKRIPDMTIINKQLGWNPKTSLWDLLDSTLTYQHRTYAEAIRKAISKPVAS

SEQ ID NO: 8021 - protein, 387 aa, Mimulus guttatus
MASSRADLDGNSIKPMTICMIGAGGFIGSHLCEKLMAETPHKVLAVDVYNDKINHLLEPSSSPWAERIQFHRINIKNDSRLEGLIRMADLTINLAAICTPADYNTRPLDTIYSNFIDALPVVKYCSENSKRLIHFSTCEVYGKTVGCFLPKDSPLRQEPANYVLSEDTSPCIFGPIEKQRWSYACAKQLIERLIYAEGAENGLEFTIVRPFNWIGPRMDFIPGIDGPSEGVPRVLACFSNNLLRGEPLKLVDGGESQRTFVYIKDAIEAVLLMIENPARANGHIFNVGNPNNEVTVRQLAEMMTQVYTKVSGEPALASPTIDISSKEFYGEGYDDSDKRIPDMTIINRQLGWNPKTSLWDLLESTLTYQHRTYAEAVKKSTSVPVSS

SEQ ID NO: 8022 - protein, 388 aa, Artemisia annua
MTSSARVDLDGNAIKPLTICMIGAGGFIGSHLCEKLMNETDHTVLAVDVYNDKIKHLLEPDSLPWNGRIQFHRLNIKNDSRLEGLIKCSDLTVNLAAICTPADYNTRPLDTIYSNFIDALPVVKYCSENNKRLIHFSTCEVYGKTIGSYLPKDSPLRQDPAYYILKEDTSPCIFGSIEKQRWSYACAKQLIERLIYAEGAENGLEFTIVRPFNWIGPRMDFIPGIDGPSEGVPRVLACFSNNLLRREPLKLVDGGESQRTFVYIKDAIEAVHLMIENPARANGHIFNVGNPNNEVTVRQLAEMMTKVYAKVSGEDSIETPTIDVSSKEFYGEGYDDSDKRIPDMTIINKQLGWDPKTSLWDLLESTLTYQHRTYAEAVKQSISKPIAN

SEQ ID NO: 8023 - protein, 386 aa, Coffea canephora
MAGRVDLDGNPIKPMTICMIGAGGFIGSHLCEKLMSETEHKVLAVDVYSDKIKHLLEPASLPWAGRIQFHRLNIKNDSRLEGLIKMADLTINLAAICTPADYNTRPLDTIYSNFIDALPVVKYCSENGKRLIHFSTCEVYGKTIGSFLPKDSQLRQDPAYYVLKEDTSPCIFGSIEKQRWSYACAKQLIERLIYAEGAENGLEFTIVRPFNWIGPRMDFIPGIDGPSEGVPRVLACFSNNLLRREPLKLVDGGQSQRTFVYIKDAIEAVHLMIENPARANGQIFNVGNPNNEVTVRQLAEMMTEVYAKVSGEPPLEAATIDVSSKEFYGEGYDDSDKRIPDMTIINKQLGWNPKTSLWDLLDSTLTYQHRTYAEAIRKAISRPVAS

SEQ ID NO: 8024 - protein, 386 aa, Gossypium hirsutum
MAARMDLDGRPIKPMTICMIGAGGFIGSHLCEKLMAETPHRVLALDVYNDKIKHLLEPDSLPWAGRIEFHRINIKHDSRLEGLVKMADLTINLAAICTPADYNTRPLDTIYSNFIDALPVVKYCSENSKRLIHFSTCEVYGKTIGSFLPKDSPLRKDPAYYVLKEDTSPCIFGSIEKQRWSYACAKQLIEKLIYAEGAENGLDFTIVRPFNWIGPKMDFIPGIDGPSEGVPRVLACFSNNLLRREPLKLVDGGQSQRTFVYIKDAIEAVLLMIENPDRANGHIFNVGNPNNEVTVRQLAEMMTQVYTMVSGEPMLQSPSIDVSSKEFYGEGYDDSDKRIPDMTIINKQLGWNPKTSLWDLLESTLTYQYRTYAEAIKKSMAKPTAS

SEQ ID NO: 8025 - protein, 390 aa, Lactuca sativa
MAASSARVDLDGNTINPFTICMIGAGGFIGSHLCEKLLTETPHTVLAVDVYNDKIKHLLEGPDSLPWAGRIQFHRLNIKNDSRLEGLIKCSDLTVNLAAICTPADYNTRPLDTIYSNFIDALPVVKYCSENNKRLIHFSTCEVYGKTIGSYLPQDSPLRQDPAYYILKEDTSPCIFGPIEKQRWSYACAKQLIERLIYAEGAENGLEFTIVRPFNWIGPRMDFIPGIDGPSEGVPRVLACFSNNLLRREPLKLVDGGESQRTFVYIKDAIEAVLLMIENPARANGHIFNVGNPNNEVTVRQLAEMMTKVYSKVSGEDSIETPTVDVSSKEFYGEGYDDSDKRIPDMTIINKQLGWDPKTSLWDLLESTLTYQHRTYAEAVKQSVAKAVAS

SEQ ID NO: 8026 - protein, 389 aa, Tragopogon dubius
MATSSARVDLDGNTINPMTICMIGAGGFIGSHLCEKLMSETPHTVLAVDVYNDKIKHLLEPDSLPWAGRIQFHRLNIKNDSRLEGLIKCSDLTVNLAAICTPADYNTRPLDTIYSNFIDALPVVKYCSENNKRLIHFSTCEVYGKTIGSYLPQDSPLRQDPAYYILKEDTSPCIFGPIEKQRWSYACAKQLIERLIYAEGAENGMEFTIVRPFNWIGPRMDFIPGIDGPSEGVPRVLACFSNNLLRREPLKLVDGGESQRTFVYIKDAIEAVLLMIENPARANGHIFNVGNPNNEVTVRQLAEMMTKVYSKVSGEDSIETPTIDVSSKEFYGEGYDDSDKRIPDMTIINKQLGWDPKTSLWDLLESTLTYQHRTYAEAVKKSIAKPVAN

SEQ ID NO: 8027 - protein, 389 aa, Tragopogon dubius
MASTTARVDLDGNTINPMTICMIGAGGFIGSHLCEKLMTETPHTVLAVDVYNDKIKHLLEPDTHPWAGRIQFHRLNIKNDSRLEGLIKCSDLTINLAAICTPADYNTRPLDTIYSNFIDALPVVKYCSENSKRLIHFSTCEVYGKTIGSYLPKDSPLRQDPAYYILKEDTSPCIFGSVEKQRWSYACAKQLIERLIYAEGAENGLEFTIVRPFNWIGPRMDFIPGIDGPSEGVPRVLACFSNNLLRREPLKLVDGGESQRTFVYIKDAIEAVLLMIENPARASGHIFNVGNPNNEVTVRELAEMMTKVYSKVSGEDSIETPTIDVSSKEFYGEGYDDSDKRIPDMSIINKQLGWDPKTSLWDLLESTLTYQHKTYAEAIKQAIAKPVAN

SEQ ID NO: 8028 - protein, 389 aa, Cichorium intybus
MASTTARVDLDGNTINPMTICMIGAGGFIGSHLCEKLMNETPHTVLAVDVYNDKIKHLLEPDSLPWAGRIQFHRLNIKNDSRLEGLIKCSDLTINLAAICTPADYNTRPLDTIYSNFIDALPVVKYCSENSKRLIHFSTCEVYGKTIGSYLPKDSPLRQDPAYYILKEDTSPCIFGSVEKQRWSYACAKQLIERLIYAEGAENGLEFTIVRPFNWIGPRMDFIPGIDGPSEGVPRVLACFSNNLLRREPLKLVDGGESQRTFVYIKDAIEAVLLMIENPARASGHIFNVGNPNNEVTVRQLAEMMTKVYSKVSGEDSIETPTIDVSSKEFYGEGYDDSDKRIPDMTIINKQLGWDPKTSLWDLLESTLTYQHKTYAEAIKQAIAKPVAN

SEQ ID NO: 8029 - protein, 389 aa, Lactuca sativa
MASTTARLDLDGNTINPMTICMIGAGGFIGSHLCEKLMQETPHTVLAVDVYNDKIKHLLEPDSLPWAGRIQFHRLNIKNDSRLEGLIKCSDLTINLAAICTPADYNTRPLDTIYSNFIDALPVLKYCSENNKRLIHFSTCEVYGKTIGSYLPKDSPLRQDPAYYILKEDVSPCIFGSVEKQRWSYACAKQLIERLIYAEGAENGLEFTIVRPFNWIGPRMDFIPGIDGPSEGVPRVLACFSNNLLRREPLKLVDGGESQRTFVYIKDAIEAVLLMIENPGRASGHIFNVGNPNNEVTVRQLAEMMTKVYSKVSGEDSIETPTIDVSSKEFYGEGYDDSDKRIPDMTIINKQLGWNPKTSLWDLLESTLTYQHKTYAEAIKQAIAKPLAN

SEQ ID NO: 8030 - protein, 389 aa, Helianthus annuus
MTSSTARVDLDGNPVKPLTICMIGAGGFIGSHLCEKLLSETQHTVLAVDVYNDKIKHLLEPDSLPWAGRIQFHRINIKNDSRLEGLIKCSDLTVNLAAICTPADYNTRPLDTIYSNFIDALPVVKYCSENNKRLIHFSTCEVYGKTIGSFLPQDSPLRQDPAYYILKEDTSPCIFGSIEKQRWSYACAKQLIERLIYAEGAENGLEFTIVRPFNWIGPRMDFIPGIDGPSEGVPRVLACFSNNLLRREPLKLVDGGQSQRTFVYIKDAIEAVHLMIENPARANGHIFNVGNPNNEVTVRQLAEMMTKVYAKVSGEDSIETPTIDVSSKEFYGEGYDDSDKRIPDMTIINKQLGWDPKTSLWDLLESTLTYQHRTYAEAVRQSIAKPLAN

SEQ ID NO: 8031 - protein, 386 aa, Unknown
  Sequence found in Organisms: Solanum tuberosum, Solanum phureja
MAGRVDLDGNPIKPMTICMIGAGGFIGSHLCEKLMSETPHTVLAVDVYSDKIKHLLEPTSLPWNGRIQFHRINIKNDSRLEGLIKMADLTVNLAAICTPADYNTRPLDTIYSNFIDALPVVKYCSENGKRLIHFSTCEVYGKTIGAFLPEDSPLRQDPAYFVLSEEASPCIFGPIEKQRWSYACAKQLIERLIYAEGAENGLEFTIVRPFNWIGPRMDFIPGIDGPSEGVPRVLACFSNNLLRHEPLKLVDGGHSQRTFIYIKDAIEAVFLMIENPARANGHIFNVGNPNNEVTVKQLAEMMTQVYSKVSGETPLETPTVDVSSKEFYGEGYDDSDKRIPDMTIINRQLGWNPKTSLWDLLESTLTYQHRTYAEAVKQAMSKTTAN

SEQ ID NO: 8032 - protein, 354 aa, Brassica juncea
KLMNETPHKVLALDVYNDKIKHLLEPGTSQWGERIQFHRINIKHDSRLEGLVKMADLTINFAAICTPADYNTRPLDTIYSNFIDALPVVKYCSENNKRLIHFSTCEVYGKTIGSFLPKDHPLRQDPEFYVLKEDTSPCIFGSIEKQRWSYACAKQLIERLVYAEGAENGLEFTIVRPFNWIGPRMDFIPGIDGPSEGVPRVLACFSNNLLRREPLKLVDGGESQRTFIYIKDAIEAVLLMIENPERANGHIFNVGNPNNEVTVRQLAEMMTKVYSKVSGETAIESPTIDVSSKEFYGEGYDDSDKRIPDMTIINRQLGWNPKTSLWDLLESTLTYQHRTYAEAVKKATSKPVAS

SEQ ID NO: 8033 - protein, 386 aa, Solanum tuberosum
MAGKVDLDGNPIKPMTICMIGAGGFIGSHLCEKLMSETPHTVLAVDVYSDKIKHLLEPTSLPWNGRIQFHRINIKNDSRLEGLIKMADLTVNLAAICTPADYNTRPLDTIYSNFIDALPVVKYCSENGKRLIHFSTCEVYGKTIGAFLPEDSPLRQDPAYFVLSEEASPCIFGPIEKQRWSYACAKQLIERLIYAEGAENGLEFTIVRPFNWIGPRMDFIPGIDGPSEGVPRVLACFSNNLLRHEPLKLVDGGHSQRTFIYIKDAIEAVFLMIENPARANGHIFNVGNPNNEVTVKQLAEMMTQVYSKVSGETPLETPTVDVSSKEFYGEGYDDSDKRIPDMTIINRQLGWNPKTSLWDLLESTLTYQHRTYAEAVKQAMSKTTAN

SEQ ID NO: 8034 - protein, 387 aa, Castanea mollissima
MAARVDLDGKPIKPLTICMIGAGGFIGSHLCEKLMAETPHKVMALDVYSDKIKHLLEPAGAHPWSDRIQFHRLNIKNDSRLEGLIKMSDLTINLAAICTPADYNTRPLDTIYSNFIDALPVVKYCSENNKRLIHFSTCEVYGKTIGSFLPKDSPLRKEPEYFVLKEDESPCIFGPIEKQRWSYACAKQLIERLIYAEGAENGLEFTIVRPFNWIGPRMDFIPGIDGPSEGVPRVLACFSNNLLRHEPLKLVDGGVSQRTFVYIKDAIEAVMLMIENPARANGHIFNVGNPNNEVTVRQLAEMMTDVYSKVSGEPSLEEPTVDVSSQEFYGAGYDDSDKRIPDMTIIHKQLGWDPKTSLWDLLESTLTYQHRTYAEAMKQAIAKPAAN

SEQ ID NO: 8035 - protein, 387 aa, Quercus alba
MAARVDLDGKPIKPLTICMIGAGGFIGSHLCEKLMAETPHKVLGLDVYSDKIKHLLEPAGAHPWSDRIQFHRLNIKNDSRLEGLIKMSDLTINLAAICTPADYNTRPLDTIYSNFIDALPVVKYCSENNKRLIHFSTCEVYGKTIGSFLPKDSPLRKEPEYFVLKEDESPCIFGPIEKQRWSYACAKQLIERLIYAEGAENGMEFTIVRPFNWIGPRMDFIPGIDGPSEGVPRVLACFSNNLLRHEPLKLVDGGVSQRTFVYIKDAIEAVMLMIENPARANGHIFNVGNPNNEVTVRQLAEMMTDVYSKVSGEPSLEEPTVDVSSQEFYGVGYDDSDKRIPDMTIINKQLGWDPKTSLWDLLESTLTYQHRTYAEAMKQAIAKPAAN

SEQ ID NO: 8036 - protein, 387 aa, Quercus alba
MAARVDLDGKPIKPLTICMIGAGGFIGSHLCEKLMAETPHKVLGLDVYSDKIKHLLEPAGAHPWSDRIQFHRLNIKNDSRLEGLIKMSDLTINLAAICTPADYNTRPLDTIYSNFIDALPVVKYCSENNKRLIHFSTCEVYGKTIGSFLPKDSPLRKEPEYFVLKEDESPCIFGPIEKQRWSYACAKQLIERLIYAEGAENGMEFTIVRPFNWIGPRMDFIPGIDGPSEGVPRVLACFSNNLLRHEPLKLVDGGVSQRTFVYIKDAIEAVMLMIENPARANGHIFNVGNPNNEVTVRQLAEMMTDVYSKVSGEPSLEEPTVDVSSQEFYGAGYDDSDKRIPDMTIIHKQLGWDPKTSLWDLLESTLTYQHRTYAEAMKQAIAKPAAN

SEQ ID NO: 8037 - protein, 386 aa, Solanum lycopersicum
MAGRVDLDGNPINPMTICMIGAGGFIGSHLCEKLMSETQHTVLAVDVYSDKIKHLLEPTSLPWNGRIQFHRINIKNDSRLEGLIKMADLTVNLAAICTPADYNTRPLDTIYSNFIDALPVVKYCSENGKRLIHFSTCEVYGKTIGAFLPEDSPLRQDPAYFLLSEDASPCIFGPIEKQRWSYACAKQLIERLIYAEGAENGLEFTIVRPFNWIGPRMDFIPGIDGPSEGVPRVLACFSNNLLRHEPLKLVDGGHSQRTFIYIKDAIEAVSLMIENPARANGHIFNVGNPNNEVTVKQLAEMMTQVYSKVSGETPLETPTVDVSSKEFYGEGYDDSDKRIPDMTIINRQLGWNPKTSLWDLLESTLTYQHRTYAEAVKQAMSKTTTN

SEQ ID NO: 8038 - protein, 386 aa, Solanum tuberosum
MAGRVDLDGNPIKPMTICMIGSGGFIGSHLCEKLMSETPHTVLAVDVYSDKIKHLLEPTSLPWNGRIQFHRINIKNDSRLEGLIKMADLTVNLAAICTPADYNTRPLDTIYSNFIDALPVVKYCSENGKRLIHFSTCEVYGKTIGAFLPEDSPLRQDPAYFVFSEEASPCIFGPIEKQRWSYACAKQLIERLIYAEGAENGLEFTIVRPFNWIGPRMDFIPGIDGPSEGVPRVLACFSNNLLRHEPLKLVDGGHSQRTFIYIKDAIEAVFLMIENPARANGHIFNVGNPNNEVTVKQLAEMMTQVYSKVSGETPLETPTVDVSFKEFYGEGYDDSDKRIPDMTIINRQLGWNPKTSLWDLLESTLTYQHRTYAEAVKQAMSKTTAN

SEQ ID NO: 8039 - protein, 383 aa, Liriodendron tulipifera
  misc_feature (377)..(377): Xaa can be any naturally occurring amino acid
MASSRVDLDGRPIKPFTICMIGAGGFIGSHLCEKLLAETAHKILAVDVYNDKIKHLLEPSPSNPTLPWADRIQFHRINIKHDSRLEGLIKMADLTINLAAICTPADYNTRPLDTIYSNFIDAIPVVKYCSENSKRLIHFSTCEIYGKTIGSFLPKDHPLRQDPSFYVLKEDASPCIFGPIEKQRWSYACAKQLIERLIYAEGAENGLEFSIVRPFNWIGPRMDFIPGVDGPSEGVPRVLACFSNNLLRGEPLKLVDGGQSQRTFVYIKDAIEAVLLMIENPERANGHIFNVGNPNNEVTVKQLAEMMTEVYSKVSGEPALEVPTIDVSSKEFYGEGYDDSDKRIPDMTIINKQLGWNPKTSLWDLLESTLTYHTGHXPRPSSS

SEQ ID NO: 8040 - protein, 373 aa, Ricinus communis
MANRVDLDGRPIKEMTICMIGAGGFIGSHLCEKILNETPHKILALDVYNDKIKHLLEPDSLPWAGRIQFHRINIKHDSRLEGLIKMADLTINLAAICTPADYNTRPLDTIYSNFIDALPVVKYCSENNKRLIHFSTCPSYFSWDPAYYILKEDESPCIFGSIEKQRWSYACAKQLIERLIYAEGAENGLEFTIVRPFNWIGPRMDFIPGIDGPSEGVPRVLACFSNALLRGEPLKLVDGGQSQRTFVYIKDAIEAVLLMIENPARANGHIFNVGNPHNEVTVKQLAEMMTEVYSKVSGEPVLEVPTVDISSKEFYGEGYDDSDKRIPDMTIINRQLGWNPKTSLWDLLESTLTYQHRTYAEAIKKVLAKPTSS

SEQ ID NO: 8041 - protein, 95 aa, Zingiber officinale
MASVARLDLDGNPIDPMTICMIGAGGFIGSHLCEKLMAETPHTVLAVDVYCDKIKHLLDPEEGQEASRGRIQFPPPQYQARFQTGGTHQDVGFND

SEQ ID NO: 8042 - protein, 388 aa, Cynara scolymus
  misc_feature (130)..(130): Xaa can be any naturally occurring amino acid
  misc_feature (142)..(142): Xaa can be any naturally occurring amino acid
  misc_feature (291)..(291): Xaa can be any naturally occurring amino acid
  misc_feature (380)..(380): Xaa can be any naturally occurring amino acid
MATSSARVDLDGNTIKPFTICMIGAGGFIGSHLCEKLMSETPHTVLAVDVYNDKIKHLLEPDSLPWAGRIQFHRLNIKNDSRLEGLIKCSDLTVNLAAICTPADYNTRPLDTIYSNFLMRFLWLVLFREXKRLIHFSTCEVXGKTIGSYLPKDSPLRQDPAYYILKEDTSPCIFGSIEKQRWSYACAKQLIERLIYAEGAENGLEFTIVRPFNWIGPRMDFIPGIDGPSEGVPRVLACFSNNLLRREPLKLVDGGESQRTFVYIKDAIEAVLLMIENPGRANGHIFNVGNXNNEVTVRQLAEMMTKVYAKVSGEDSIESPTIDVSSKEFYGEGYDDSDKRIPDMTIINKQLGWDPKTSLWDLLESTLTYQHRTYAEAVKXSIAKAVAN

SEQ ID NO: 8043 - protein, 98 aa, Zingiber officinale
  misc_feature (71)..(75): Xaa can be any naturally occurring amino acid
  misc_feature (92)..(92): Xaa can be any naturally occurring amino acid
MAAVARLDLDGSPIAPMTICMIGAGGFIGSHLCEKLMAETPHTVLAVDVYNDKIKHLLDPPAYAEGQQARXXXXXGSSSTASTSSTIPGSRXSSRCPT

SEQ ID NO: 8044 - protein, 395 aa, Zingiber officinale
MASAARLDLDGKPIEPMTICMIGAGGFIGSHLCEKLMAETPHTVLAVDVYSDKIKHLLDAAEGQEAARRPWGGRIQFHRLNIKNDSRLEGLIKMSDLTINLAAICTPADYNTRPLDTIFSNFIDALPVVKYCSENNKRVIHFSTCEVYGKTIGSFLPNDHPLRKEPEFFVLKEDVSPCIFGPIEKQRWSYACAKQLIERLIYAEGAENGLEFTIVRPFNWIGPRMDFIPGIDGPSEGVPRVLACFSNNLLRREPLKLVDGGQSQRTFVYIKDAIEAVLLMIENPARANGHIFNVGNPNNEVTVKQLAEIMTQVYSNVSGEPALEVPTIDVSSKDFYGEGYDDSDKRIPDMTIINKQLGWNPKTSLWDLLDSTLTYQHKTYAEAIRRSIAKPAASH

SEQ ID NO: 8045 - protein, 386 aa, Cycas rumphii
MAVRVDLDGHEIEPMTICMIGAGGFIGSHLCEKLMAETQHKVLAIDVYSDKIQPLLEPGLPWAGRIEFYRINIKHDSRLEGLIKMADLTINLAAICTPADYNTRPLDTMYSNFMDALPVVRYCSENGKRLIHFSTCEVYGKTIGSFLPKGHPLRQDPAFYVLKEDVSPCIFGPIEKQRWCYACAKQLIERVIFAEGAENGLEFTIVRPFNWIGPRMDFIPGIDGPSEGVPRVLACFSNGLLRGEPLKLVDGGQSQRTFVYIKDAIEAVLLMIENPSRANGHIFNVGNPNNEVTVKQLAELMTEVYSKVTGQPPLDVPTIDVSSQEFYGEGYDDSDKRIPDMTIITERLGWEPKTSLSDLLESTLTYQHKTYSHAVKQTMSKFVASS

SEQ ID NO: 8046 - protein, 352 aa, Euphorbia esula
MATGNRVDLDGRPIKPMTICMIGAGGFIGSHLCEKILFETPHKILALDVYNDKIKHLLEPECATWGDRIQFHRINIKHDSRLEGLIKMSDLIINLAAICTPADYNTRPLDTIYSNFIDALPVVKYCSENTKRLIHFSTCEVYGKTIGSFLPKDSPLREDPAYYILKEDTSPCIFGSIEKQRWSYACAKQLIERLIYAEGAENGLEFTIVRPFNWIGPRMDFIPGIDGPSEGVPRVLACFSNALLRREPLKLVDGGESQRTFVYIKDAIDAVLLMIENPARANGHIFNVGNPHNEVTVRQLAEMMTEVYSKVSKEPALESPTVDVSSKEFYGEGYDDSDKRIPDMTIINRQLG

SEQ ID NO: 8047 - protein, 386 aa, Zamia vazquezii
MAGRVDLDGNRIEPMTICMIGAGGFIGSHLCEKLMAETEHKVLAIDVYSDKIQPLLEPGLPWAGRIEFHRINIKHDPRLEGLIKGSDLTINLAAICTPADYNTRPLDTMYSNFMDALPVVRYCSENNKRLIHFSTCEVYGKTIGSFLPKDHPLRQDPAFYVLKEDVSPCILGPIEKQRWCYACAKQLIERVIYAEGAENGLEFTIVRPFNWIGPRMDFIPGIDGPSEGVPRVLACFSNGLLRGEPLKLVDGGQSQRTFVYIKDAIEAVHLMIENPSRANGHIFNVGNPNNEVTVKQLAEMMTEVYSKITGQPPLDVPTIDISSQEFYGEGYDDSDKRIPDMTIIRERLGWEPKTSLWDLLDSTLTYQHKTYSHAVKQAMSKSIASN

SEQ ID NO: 8048 - protein, 356 aa, Taraxacum officinale
MAESSARVDLDGNTINPMTICMIGAGGFIGSHLCEKLLSETPHTILAVDVYNDKIKHLLEPDSLPWAGRIQFHRLNIKNDSRLEGLIKCSDLIVNLAAICTPADYNTRPLDTIYSNSIDALPVVKYCSDNNKRLIHFSTCEIYGKTIGSYLPKDSPLRQDPAYYILKEDTSPCIFGPIEKQRWSYACAKQLIERLIFAEGAENGLEFTIVRPFNWIGPRMDFIPGIDGPSEGVPRVLACFSNNLLRREPLKLVDGGESQRTFVYIKDAIEAVLLMIENPGRANGHIFNVGNPNNEVTVRQLAEMMTKVYSKVSGEDSIETPTIDVSSKEFYGEGYDDSDKRIPDMTIINTGLTLRQ

SEQ ID NO: 8049 - protein, 351 aa, Carica papaya
AETQHKVLALDVYNDKIKHLLEPSSLPWADRIQFHRLNIKHDSRLEGLIKMADLTINLAAICTPADYNTRPLDTIYSNFIDALPVVKYCSENNKRLIHFSTCEVYGKTVGSFLPKDHPLRQDPAYYVLKEDESPCIFGSIEKQRWSYACAKQLIERLIFAEGAENGLEFTIVRPFNWIGPRMDFIPGVDGPSEGVPRVLACFSNNLLRRLPLKLVDGGQSQRTFVYIKDAIEAVHLMIENPSRANGHIFNVGNPNNEVTVRQLAEMMTQVYSKVSGDPALDSPTIDVSSKEFYGEGYDDSDKRIPDMTIINRQLGWNPKTSLWDLLESTLTYQHRTYAEAIKQVISKPATN

SEQ ID NO: 8050 - protein, 388 aa, Brassica napus
MADNTDNRRAIWGVPEKLQLHIAMLTLQFGYAGFHVVSRAALNMGISKLVFPVYRNIIALLLLLPFAYFLEKKERPAITLNFLIQFFFLALIGITANQGFYLLGLDYTSPTFASSMQNSVPAITFLMAALLRIEKVRINRRDGISKVLGTALCVAGASVITLYKGPTIYTPTSNLHAHLLTTNSAASAVLAPLGDAAPKNWTLGCIYLIGHCLSWSGWLVFQAPVLKSYPARLSVTSYTLLFGIIQFVIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAAIQSSAEHGIERAPVSRGSITTPLLHQSTNNV

SEQ ID NO: 8051 - protein, 204 aa, Raphanus sativus
MADNTDNRRAIWGVPEKLQLHIAMLTLQFGYAGFHVVSRAALNMGISKLVFPVYRNIIALLLLLPFAYFLEKKERPAITLNFLIQFFFLALIGITANQGFYLLGLDYTSPTFASSMQNSVPAITFLMAALLRIEKVRINRRDGISKVLGTALCVAGASVITLYKGPTIYTPTSHLHTHLLTTNPAVLAPLGDAAPKTGLLAAST

SEQ ID NO: 8052 - protein, 386 aa, Brassica napus
MADNTDRRAIWGVPEKLQLHIAMLTLQFGYAGFHVVSRAALNMGISKLVFPVYRNIIALLLLLPFAYFLEKKERPAITLNFLIQFFFLALIGITANQAFYLLGLDYTSPTFASSMQNSVPAITFLMAALLRIEKVRINRRDGISKVLGTALCVAGASVITLYKGPTIYTPTSHLHAHLLTTNSAILAPLGDAAPKNWTLGCLYLIGHCLSWSGWLVFQAPVLKSYPARLSVTSYTLLFGIIQFVIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAMIHAEHVIERAPVSRGSVKSSITAPLLHQSTDNV

SEQ ID NO: 8053 - protein, 386 aa, Brassica rapa
  misc_feature (18)..(18): Xaa can be any naturally occurring amino acid
MADNTDRRAIWGVPEKLXLHIAMLTLQFGYAGFHVVSRAALNMGISKLVFPVYRNIIALLLLLPFAYFLEKKERPAITLNFLIQFFFLALIGITANQAFYLLGLDYTSPTFASSMQNSVPAITFLMAALLRIEKVRINRRDGISKVLGTALCVAGASVITLYKGPTIYTPTSHLHAHLLTTNSAILAPLGDAAPKNWTLGCLYLIGHCLSWSGWLVFQAPVLKSYPARLSVTSYTLLFGIIQFVIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAMIHAEHVIERAPVSRGSVKSSITAPLLHQSTDNV

SEQ ID NO: 8054 - protein, 204 aa, Raphanus sativus
MADNTDNRRAIWGVPEKLQLHIAMLTLQFGYAGFHVVSRAALNMGISKLVFPVYRNIIALLLLLPFAYFLEKKERPAITLNFLIQFFFLALIGITANQGFYLLGLDNTSPTFASSMQNSVPAITFLMAALLRIEKVRINRRDGISKVLGTALCVAGASVITLYKGPTIYTPTSHLHAHLLTTNPAVLAPLGDAAPKTGLLVAST

SEQ ID NO: 8055 - protein, 496 aa, Brassica napus
MAMIGLLEVFVAFLFFLVFKHFFLHKKSPGQPILKSWPVLGMLPGMLPHIPRIFDWTFEVLEATNLTFFFKGPWFSGTDMLFTADPRNIHHILSLNFGNYPKGPEFKKIFDVLGDGILSADLELWEDLRKSNHAIFHHPDFLKLSASSNTIKLKEGLVPFLDNAAHENIVIDLQDVFKRFMFDTSSISLTGYDPMSLSTEMPEVEYGEATETGEEAIYYRHFKPVILWRLQNWLGIGLERKMKSSLVTVNRMFAKIISTRREEISRGEGEQLMDALTYYINVDTTKYKLLKPSNDTFIRDVAFSLLLAGRDTTSSVLTWFFWLLSKHPHVMTKIRQEINTKFDPTDLEKLVYLHATLNETMRLYPPVPFNHKSPLKSDVLPSGHKVKAESKIVICIYALGRMRSVWGEDALDFKPERWISESGELKHEPSYKFMAFNAGPRACLGKHLALPQMKIVAVEIIQNYDFKVTEGHKIEAVPSIVLRMKNGLSVTVTKKM

SEQ ID NO: 8056 - protein, 455 aa, Brassica napus
MLPGMLPHIPRIFDWTFEVLEATNLTFFFKGPWFSGTDMLFTADPRNIHHILSLNFGNYPKGPEFKKIFDVLGDGILSADLELWEDLRKSNHAIFHHPDFLKLSASSNTIKLKEGLVPFLDNAAHENIVIDLQDVFKRFMFDTSSISLTGYDPMSLSTEMPEVEYGEATETGEEAIYYRHFKPVILWRLQNWLGIGLERKMKSSLVTVNRMFAKIISTRREEISRGEGEQLMDALTYYINVDTTKYKLLKPSNDTFIRDVAFSLLLAGRDTTSSVLTWFFWLLSKHPHVLTKIRQEINTKFDPTYLEKLVYLHAALYETMRLYPPVPFNHKSPLKSDVLPSGHKVKAESKIVICIYALGRMRSVWGEDALDFKPERWISESGELKHEPSYKFMAFNAGPRACLGKHLALQQMKIVAVELIQNYDFKFTEGHKIEAVPSIVLRIKNGLSVTVTKKM

SEQ ID NO: 8057 - protein, 499 aa, Arabidopsis lyrata
MAMLGLLELFVAFLFSLVFLFTCFFIHKKPHGQPILKNWPFLGMLPGMLPQIPRIYDWTVEVLEASNLTFYFKGPWLSGTDMLFTADPKNINHILSSNFGNYPKGPEFKKIFDVLGEGILTVDLELWEDLRKSNHAMFHNQDFLELSLSSNKSKLKEGLVPFLDNAAHENIIIDLQDVFMRFMFDTSSILMTGYDPMSLSIEMLEVEFGEAADIGEEAIYYRHFKPVMLWRLQNWLGIGLERKMRTALATVNRMFAKIISSRRKEEISRGETEPSKDALTYYMNVDTTKYKLLKPKNDTFIRDVIFSLVLAGRDTTSSALTWFFWLLSKNPQVMAKIRHEINTKYDPEDLEKLVYLHAALSESMRLYPPLPFNHKAPAKPDVLPSGHKVEPESKIVICIYALGRMRSVWGEDASDFKPERWISDNGGLRHEPSYKYVAFNSGPRTCLGKHLALLQMKIVALEIIKNYDFKVIEGHKIEAIPSILLRMKHGLKVTVTKKM

SEQ ID NO: 8058 - protein, 348 aa, Brassica oleracea
  misc_feature (118)..(118): Xaa can be any naturally occurring amino acid
MSYEKELAAAKKAVALAARLSRGVQKTLMQSEVWTKSNKTPVTAADYGSQAVVSIVLERELKPVTLSLVAEEDTGDLRKKGSEVFLEGITKLVRDTLASDESYADSPITKEDVLNAIXCGKSQGGSTGCHWVLDPIDGTRGFVRGEQYAVGLALLVEGKVVVGVMACPNLHLSSAVVEKDDKSCQDNVGCLFFATTGSGAYVQPLNGNSPPQEVRVSSNENLEEAKFLESYHMPIPLHSSIAKKLGITALPVRIDSQAKYAAVSRGDAEMYLRFTLAGYREWIWDHAAGSIITTEAGGVVCDAEGTPLDFSKGKRLDHNRGIIVTTKKLKPLILKAVRESMEEENLRV

SEQ ID NO: 8059 - protein, 349 aa, Brassica rapa
MSYEKELGAAKKAVSLAARLSQGVQKTLLQSEVWTKSDKTPVTAADYGSQAVVSLVLERELKPATLSLVAEEVDTRDLRKKGSEEFLEDITKLVRDTLASDESYAGSSITTEDVLNAIDCGKSQGGSSGCHWVLDPIDGTRGFVRGEQYAVGLALLVEGKVVVGVMACPNLPLSSAVVEKDDKSCQDNVGCLFFAATGSGAYVQPLNGNSPPQEVRVSSNENLEEAKFLESYHMPIPLHSSIAKKLGITALPVRIDSQAKYAAVSRGDAEMYLRFTLVGYREWIWDHAAGSIITTEAGGVVCDVEGTPLDFSKGKRLDHNRGIIVTTKKLKPLILKAVRESMEEENFRV

SEQ ID NO: 8060 - protein, 348 aa, Brassica napus
MSYEKELAAAKKAVALAARLSQGVQKTLMQSEVWTKSDKTPVTAADYGSQAVVSIVLERELKPATLSLVAEEDTRDLRKKGSEEFLEDITKLVRDTLASDESYADSPITKEDVLNAIDCGKSQGGSSGCHWVLDPIDGTRGFVRGEQYAVGLALLVEGKVVVGVMACPNLHLSSAVVEKDDKSCQDNVGCLFFATTGSGAYVQPLNGNSPPQEVRVSSNENLEEAKFLESYHMPIPLHSSIATKLGITALPGRIDSQAKYAAVSKRDAEMYLRFTLVGYREWIWDHAAGSIITTEAGGVVCDAEGIPLDFSKGKRLDHNRGIIVTTKKLKPLILKAVRESMEEENIRV

SEQ ID NO: 8061 - protein, 348 aa, Brassica napus
  misc_feature (8)..(8): Xaa can be any naturally occurring amino acid
  misc_feature (15)..(15): Xaa can be any naturally occurring amino acid
  misc_feature (22)..(22): Xaa can be any naturally occurring amino acid
  misc_feature (29)..(29): Xaa can be any naturally occurring amino acid
  misc_feature (55)..(55): Xaa can be any naturally occurring amino acid
  misc_feature (57)..(57): Xaa can be any naturally occurring amino acid
  misc_feature (64)..(64): Xaa can be any naturally occurring amino acid
  misc_feature (75)..(75): Xaa can be any naturally occurring amino acid
  misc_feature (78)..(78): Xaa can be any naturally occurring amino acid
  misc_feature (80)..(80): Xaa can be any naturally occurring amino acid
  misc_feature (86)..(86): Xaa can be any naturally occurring amino acid
  misc_feature (88)..(88): Xaa can be any naturally occurring amino acid
  misc_feature (105)..(105): Xaa can be any naturally occurring amino acid
  misc_feature (107)..(107): Xaa can be any naturally occurring amino acid
  misc_feature (110)..(110): Xaa can be any naturally occurring amino acid
  misc_feature (127)..(127): Xaa can be any naturally occurring amino acid
  misc_feature (171)..(171): Xaa can be any naturally occurring amino acid
  misc_feature (195)..(195): Xaa can be any naturally occurring amino acid
  misc_feature (231)..(231): Xaa can be any naturally occurring amino acid
  misc_feature (243)..(243): Xaa can be any naturally occurring amino acid
  misc_feature (252)..(252): Xaa can be any naturally occurring amino acid
  misc_feature (265)..(266): Xaa can be any naturally occurring amino acid
  misc_feature (325)..(325): Xaa can be any naturally occurring amino acid
MSYEKELXAAKKAVXLAARLSXGVQKTLXQSEVWTKSDKTPVTAADYGSQAVVSXVXERELKPXTLSLVAEEDTXDLXKXGSEEFXEXITKLVRDTLASDESYAXSXITXEDVLNAIDCGKSQGGSXGCHWVLDPIDGTRGFVRGEQYAVGLALLVEGKVVVGVMACPNLXLSSAVVEKDDKSCQDNVGCLFFAXTGSGAYVQPLNGNSPPQEVRVSSNENLEEAKFLESXHMPIPLHSSIAXKLGITALPXRIDSQAKYAAVSXXDAEMYLRFTLVGYREWIWDHAAGSIITTEAGGVVCDAEGIPLDFSKGKRLDHNRGIIVXTKKLKPLILKAVRESMEEENIRV

SEQ ID NO: 8062 - protein, 361 aa, Brassica napus
MSYEKELAAAKKAVSLAARLSQGVQKTLFQSEVWTKSDRTPVTAADFGSQALVSIVLERELQPATFSLVAEEETGELRKQGSEVFLEGITKLVKDTLASEESYADSPPLSTEDVLNAIDCGKSEGGCSGYHWVLDPIDGTRGFVRGEQYAVGLALLVEGKVVLGVMACPNLPLASAVGETDMSSKENVGCLFFATAGLGAYVQPVEGHSLPQKVRVSSNENLEEAKFLESYHKPIPIHSSIAEKLGITALPVRMDSQAKYAAVSRGDAEIYLRFTLCGHRETIWDHAPGFIITTEAGGVVCDAAGKSLDFSKGKYLDHKTGIIVTTKKLKPCVLKAVREAMEEEKLISETHNPNCTLSVCV

SEQ ID NO: 8063 - protein, 347 aa, Arabidopsis lyrata
MSYEKELAAAKKAVSLAARLSQEVQKTLSQSQVWKKSDTSPVTAADYGSQAVVSLVLERELQPDKLSLVAEEETGDLRKKGSELFLQGITTLVKDTLASEELYTGSPLSTDDVLNAIDCGKSEGGSSGSHWVLDPIDGTRGFVRGEQYAVGLALLVEGKVVLGVMACPNLSLASAICVTDKSSQEGVGCLFFATTGSGTYVQSLKGNSLPQKVRVSSNENLDEAKFLESYHKPIPIHGTIAKKLGIKALPVRLDSQAKYAALSRGDAEIYLRFTLNGHRECIWDHAAGSIITTEAGGVVCDATGKSLDFSKGKYLAHKTGIIVTTKKLKPWILKAVRESIEEENLYF

SEQ ID NO: 8064 - protein, 1077 aa, Arabidopsis lyrata
MLRTVSCLASRSSAPLFFRFFRQFPRSYMSLTSSTAALRVPSRNLRRISSPSVAGRRLFLRRGLRIPSAAVRSVNGQFSRLSVRAVATQPAPLYPDVGQDEAEKLGFEKVSEEFISECKSKAILFKHKKTGCEVMSVSNEDENKVFGVVFRTPPKDSTGIPHILEHSVLCGSRKYPLKEPFVELLKGSLHTFLNAFTYPDRTCYPVASTNTKDFYNLVDVYLDAVFFPKCVDDVHTFQQEGWHYELNDPSEDISYKGVVFNEMKGVYSQPDNILGRIAQQAKNTYGVDSGGDPKDIPKLTFEEFKEFHRQYYHPSNARIWFYGDDDPVHRLRVLSEYLDMFEASPSPDSSKIKPQKLFSKPVRLVEKYPAGRDGDLKKKHMLCVNWLLSEKPLDLQTQLALGFLDHLMLGTPASPLRKILLESGLGEALVSSGLSDELLQPQFSIGLKGVSEDNVQKVEELIMDTLKKLAEEGFDNDAVEASMNTIEFSLRENNTGSFPRGLSLMLQSIAKWIYDMDPFEPLKYTEPLKALKTRIAEEGSKAVFSPLIEKFILNNSHRVTIEMQPDPEKATQEEVEEKNILEKVKAAMTEEDLAELARATEELKLKQETPDPPEALRCVPSLNLGDIPKEPTYVPTEVGDINGVKVLRHDLFTNDIIYAEVVFDIGSLKHELLPLVPLFCQSLLEMGTKDLTFVQLNQLIGRKTGGISVYPLTSSVRGKDEPCSKIIVRGKSMAGRADDLFNLMNCLLQEVQFTDQQRFKQFVSQSRARMENRLRGSGHGIAAARMDAMLNIAGWMSEQMGGLSYLEFLHTLEKKVDEDWEGISSSLEEIRRSLLARNGCIVNMTADGKSLTNVEKSVAKFLDLLPEKPSGGLVTWDGRLPLRNEAIVIPTQVNYVGKAGNIYSTGYELDGSAYVISKHISNTWLWDRVRVSGGAYGGFCDFDSHSGVFSYLSYRDPNLLKTLDIYDGTGDFLRGLDVDQETLTKAIIGTIGDVDSYQLPDAKGYSSLLRHLLGVTDEERQRKREEILTTSLKDFKDFAEAIDVVRDKGVAVAVASAEDIDAANNERSNFFEVKKAL

SEQ ID NO: 8065 - protein, 1080 aa, Arabidopsis thaliana
MLRTVSCLASRSSSSLFFRFFRQFPRSYMSLTSSTAALRVPSRNLRRISSPSVAGRRLLLRRGLRIPSAAVRSVNGQFSRLSVRAVATQPAPLYPDVGQDEAEKLGFEKVSEEFISECKSKAILFKHKKTGCEVMSVSNEDENKVFGVVFRTPPKDSTGIPHILEHSVLCGSRKYPVKEPFVELLKGSLHTFLNAFTYPDRTCYPVASTNTKDFYNLVDVYLDAVFFPKCVDDAHTFQQEGWHYELNDPSEDISYKGVVFNEMKGVYSQPDNILGRIAQQALSPENTYGVDSGGDPKDIPNLTFEEFKEFHRQYYHPSNARIWFYGDDDPVHRLRVLSEYLDMFEASPSPNSSKIKFQKLFSEPVRLVEKYPAGRDGDLKKKHMLCVNWLLSEKPLDLQTQLALGFLDHLMLGTPASPLRKILLESGLGEALVSSGLSDELLQPQFGIGLKGVSEENVQKVEELIMDTLKKLAEEGFDNDAVEASMNTIEFSLRENNTGSFPRGLSLMLQSISKWIYDMDPFEPLKYTEPLKALKTRIAEEGSKAVFSPLIEKLILNNSHRVTIEMQPDPEKATQEEVEEKNILEKVKAAMTEEDLAELARATEELKLKQETPDPPEALRCVPSLNLGDIPKEPTYVPTEVGDINGVKVLRHDLFTNDIIYTEVVFDIGSLKHELLPLVPLFCQSLLEMGTKDLTFVQLNQLIGRKTGGISVYPLTSSVRGKDEPCSKIIVRGKSMAGRADDLFNLMNCLLQEVQFTDQQRFKQFVSQSRARMENRLRGSGHGIAAARMDAMLNIAGWMSEQMGGLSYLEFLHTLEKKVDEDWEGISSSLEEIRRSLLARNGCIVNMTADGKSLTNVEKSVAKFLDLLPENPSGGLVTWDGRLPLRNEAIVIPTQVNYVGKAGNIYSTGYELDGSAYVISKHISNTWLWDRVRVSGGAYGGFCDFDSHSGVFSYLSYRDPNLLKTLDIYDGTGDFLRGLDVDQETLTKAIIGTIGDVDSYQLPDAKGYSSLLRHLLGVTDEERQRKREEILTTSLKDFKDFAQAIDVVRDKGVAVAVASAEDIDAANNERSNFFEVKKAL

SEQ ID NO: 8066 - protein, 1080 aa, Arabidopsis thaliana [sequence omitted]

SEQ ID NO: 8067 - protein, 224 aa, Raphanus sativus
MGKKKFIDKKKAATFELCPRDTSDPLYSDAPGGDKIFLRVDQNPVNINGFTEDNSQFDDAPEEGGEEDLAYGYSSFAGSSSSNNNPLPAHVRKEILELGYPDDGYNYLDHLREIKNTGGGSNFYSNPKFEGEHLPRDDVKAYDASRVKVSGVVVEGGGDDDKLMYSVASKTVNVKVKKAIDPEVAALLEDSDGSEFGSDVEDLEEDFVVQAQEGEGGSEVGGVC

SEQ ID NO: 8068 - protein, 357 aa, Brassica rapa
MAEHHHRIRVYLASAILLLAVINTGIAAENLSQQKLTSRILQNEIVKEVNENPNAGWIAAFNDRFANSTVAEFKRLLGVKPTPKNEFLGVPVVSHDISLKLPKEFDARTAWSQCSSIGRILDQGHCGSCWAFGAVESLSDRFCIKYNMNISLSVNDLLACCGFLCGQGCNGGYPISAWRYFKHHGVVTEECDPYFDNTGCSHPGCEPAYPTPKCVRKCVSGNQLWRESKHYGVSAYKVRHGPQDIMAEVYKNGPVEVAFTVYEDFAHYKSGVYKHITGANIGGHAVKLIGWGTSDDGEDYWLLANQWNRSWGDDGYFKIKRGTNECGIEHGVVAGLPSDRNVFNGINTSDDVLVSSF

SEQ ID NO: 8069 - protein, 357 aa, Brassica napus
MAEHHHRIRVYLASAILLLAVINTGIAAENLSEQKLTSRILQNEIVKEVNENPNAGWTAAFNDRFANSTVAEFKRLLGVKPTPKNEFLGVPVVSHDISLKLPKEFDARTAWSQCSSIGRILDQGHCGSCWAFGAVESLSDRFCIKYNMNISLSVNDLLACCGFLCGQGCNGGYPISAWRYFKHHGVVTEECDPYFDNTGCSHPGCEPAYPTPKCVRKCVSGNQLWRESKHYGVSAYKVRHDPQDIMAEVYKNGPVEVAFTVYEDFAHYKSGVYKHITGANIGGHAVKLIGWGTSDDGEDYWLLANQWNRSWGDDGYFKIKRGTNECGIEHGVVAGLPSDRNVFNGINTSDDVLVSSF

SEQ ID NO: 8070 - protein, 364 aa, Raphanus sativus
MGDHHHHHRIIRVYYLAFAILLLLLGEGNAFGADNLSNQKLTSPILQDEIVKQVNENPKAGWKAAFNDRFANSTVAEFKRLLGVKPTPKNAFLGVPVVSHDISISLKLPKQFDARTAWSQCSSIGRILDQGHCGSCWAFGAVESLSDRFCIKYNMNISLSVNDLLACCGFLCGQGCNGGYPISAWRYFKHHGVVTEECDPYFDNTGCSHPGCEPAYPTPKCVRKCVSGNQLWRESKHYGVSAYKVRHDPQDIMAEVYTNGPVEVAFTVYEDFAHYKSGVYKHITGANIGGHAVKLIGWGTSDDGEDYWLLANQWNRSWGDDGYFKIKRGTNECGIEHGVVAGLPSDRNVFRGVNTSDDVLVSSF

SEQ ID NO: 8071 - protein, 150 aa, Arabidopsis lyrata
MADKCIKLHLASVFFFLGLLISSFNLQGIAAENLSKQKLTSWILQNEIVKEVNENPNAGWKAAFNDRFANATVAEFKRLLGVKPTPKTEFLGVPIVSHDISLKLPKEFDARTAWSQCTSVGRILGLVIVVLAGPLVLLNHCLTDSASNIT

SEQ ID NO: 8072 - protein, 362 aa, Arabidopsis thaliana
MADNCIRLLHSASVFFCLGLLISSFNLLQGIAAENLSKQKLTSWILQNEIVKEVNENPNAGWKASFNDRFANATVAEFKRLLGVKPTPKTEFLGVPIVSHDISLKLPKEFDARTAWSQCTSIGRILDQGHCGSCWAFGAVESLSDRFCIKYNMNVSLSVNDLLACCGFLCGQGCNGGYPIAAWRYFKHHGVVTEECDPYFDNTGCSHPGCEPAYPTPKCARKCVSGNQLWRESKHYGVSAYKVRSHPDDIMAEVYKNGPVEVAFTVYEDFAHYKSGVYKHITGTNIGGHAVKLIGWGTSDDGEDYWLLANQWNRSWGDDGYFKIRRGTNECGIEHGVVAGLPSDRNVVKGITTSDDLLVSSF

SEQ ID NO: 8073 - protein, 278 aa, Thellungiella halophila
  misc_feature (226)..(227): Xaa can be any naturally occurring amino acid
  misc_feature (258)..(258): Xaa can be any naturally occurring amino acid
MAVSCIRLYLVSAILLLGIISSSFNLQGIAAENLTKQKLTSRILQDEIVKEVNENPNAGWKAAFNDRFANATVAEFKRLLGVKPTPKKEYLGVPIVSHDRSLKLPKEFDARTAWSQCTSIARILDQGHCGSCWAFGAVESLSDRFCIKYNMNISLSVNDLLACCGFLCGQGCNGGYPISAWRYFKHHGVVTEECDPYFDNTGCSHPGCEPAYPFPRCVRKCVSGNXXWRESKHYGVSAYKIRSNPQDIMAEVYKNGPXEVDFTFTRTLRITNLECTST

SEQ ID NO: 8074 - protein, 361 aa, Raphanus sativus
MANNHSMLYLASVILLVGIISSSFNMQGIAAENLSKQKLTSRILQEEIVKEVNENPNAGWKAALNDRFANATVAEFKRLLGVKPTPKNEYLGGVPVVTHDTSLKLPREFDARTAWSQCTSIGRILDQGHCGSCWAFGAVESLSDRFCIKYNMNISLSVNDLLACCGFLCGQGCNGGHPISAWLYFKHHGVVTEECDPYFDKTGCSHPGCEPAWSTPKCVKKCVGGNQLWDESKHYGVSAYRVSHDPQDIMAEVYKNGPVEVAFTVYEDFAHYKSGVYKHITGSNIGGHAVKLIGWGTSDDGEDYWLLANQWNRSWGDDGYFKIKRGTNECGIEHGAVAGLPSDKNIVRGINTSDDVLISSF

SEQ ID NO: 8075 - protein, 739 aa, Arabidopsis lyrata
MGTSVQVTPLCGVYNENPLSYLVSIDGFNFLIDCGWNDLFDTSLLEPLSRVASSIDAVLLSHPDTLHLGALPYAMKQLGLSAPVYATEPVHRLGLLTMYDQFLSRKQVSDFDLFTLDDIDSAFQNVIRLTYSQNYHLSGKGEGIVIAPHVAGHMLGGSIWRITKDGEDVIYAVDYNHRKERHLNGTVLQSFVRPAVLITDAYHALYTNQTARQQRDKEFLDTISKHLEVGGNVLLPVDTAGRVLELLLILEQHWSQRGFSFPIYFLTYVSSSTIDYVKSFLEWMSDSISKSFETSRDNAFLLRHVTLLINKTDLDNAPPGPKVVLASMASLEAGFAREIFVEWANDPRNLVLFTETGQFGTLARMLQSAPPPKFVKVTMSKRVPLAGEELIAYEEEQNRLKREEALRASLVKEEETKASHGSDDNSSEPMVIDTKTTHDVVGSHGPAYKDILIDGFVPPSSSVAPMFPFYDNTSEWDDFGEIINPDDYVIKDEDMDRGAMHNGGDVDGRLDEATASLMLDTRPSKVISNELIVTVSCSLVKMDYEGRSDGRSIKSMIAHVSPLKLVLVHAIAEATEHLKQHCLNNICPHVYAPQIEETVDVTSDLCAYKVQLSEKLMSNVIFKKLGDSEVAWVDSEVGKTESDMRSLLPMSGAASPHKPVLVGDLKIADFKQFLSSKGVQVEFAGGGALRCGEYVTLRKVGPTGQKGGASGPQQILIEGPLCEDYYKIRDYLYSQFYLL

SEQ ID NO: 8076 - protein, 739 aa, Arabidopsis thaliana
MGTSVQVTPLCGVYNENPLSYLVSIDGFNFLIDCGWNDLFDTSLLEPLSRVASTIDAVLLSHPDTLHIGALPYAMKQLGLSAPVYATEPVHRLGLLTMYDQFLSRKQVSDFDLFTLDDIDSAFQNVIRLTYSQNYHLSGKGEGIVIAPHVAGHMLGGSIWRITKDGEDVIYAVDYNHRKERHLNGTVLQSFVRPAVLITDAYHALYTNQTARQQRDKEFLDTISKHLEVGGNVLLPVDTAGRVLELLLILEQHWSQRGFSFPIYFLTYVSSSTIDYVKSFLEWMSDSISKSFETSRDNAFLLRHVTLLINKTDLDNAPPGPKVVLASMASLEAGFAREIFVEWANDPRNLVLFTETGQFGTLARMLQSAPPPKFVKVTMSKRVPLAGEELIAYEEEQNRLKREEALRASLVKEEETKASHGSDDNSSEPMIIDTKTTHDVIGSHGPAYKDILIDGFVPPSSSVAPMFPYYDNTSEWDDFGEIINPDDYVIKDEDMDRGAMHNGGDVDGRLDEATASLMLDTRPSKVMSNELIVTVSCSLVKMDYEGRSDGRSIKSMIAHVSPLKLVLVHAIAEATEHLKQHCLNNICPHVYAPQIEETVDVTSDLCAYKVQLSEKLMSNVIFKKLGDSEVAWVDSEVGKTERDMRSLLPMPGAASPHKPVLVGDLKIADFKQFLSSKGVQVEFAGGGALRCGEYVTLRKVGPTGQKGGASGPQQILIEGPLCEDYYKIRDYLYSQFYLL

SEQ ID NO: 8077 - protein, 450 aa, Arabidopsis lyrata
MATCPPFDFSAKYYDGDGGGCQRQSSFFGGTTVLDQGVGYAVILGFGAFFAIFTSFLVWLEKRYVGARHTSEWFNTAGRNVKTGLIASVIVSQWTWAATILQSSNVAWQYGVSGPFWYASGATIQVLLFGVMAIEIKRKAPNAHTVCEIVKARWGTATHIVFLVFCLATNVIVTAMLLLGGSAVVNALTGVNLYAASFLIPLGVVVYTLAGGLKATFLASYVHSVIVHVALVVFVFLVYTSSSELGSPSVVYDRLRDMVAKSRSCTEPLSHHDQACGPVDGNYRGSYLTMLSSGGAVFGLINIVGNFGTVFVDNGYWVSAIAARPSSTHKGYLLGGLVWFAVPFSLATSLGLGALALDLPISKDEADRGLVPPATAIALMGKSGSLLLLTMLFMAVTSAGSSELIAVSSLFTYDIYRTYINPRATGKQILRISRSAVLGFGCFMGILAVV

SEQ ID NO: 8078 - protein, 694 aa, Arabidopsis thaliana
MATCPPFDFSTKYYDGDGGCQRQSSFFGGTTVLDQGVGYAVILGFGAFFAVFTSFLVWLEKRYVGARHTSEWFNTAGRNVKTGLIASVIVSQWTWAATILQSSNVAWQYGVSGPFWYASGATIQVLLFGVMAIEIKRKAPNAHTVCEIVKARWGTATHIVFLVFCLATNVVVTAMLLLGGSAVVNALTGVNLYAASFLIPLGVVVYTLAGGLKATFLASYVHSVIVHVALVVFVFLVYTSSKELGSPSVVYDRLKDMVAKSRSCTEPLSHHGQACGPVDGNFRGSYLTMLSSGGAVFGLINIVGNFGTVFVDNGYWVSAIAARPSSTHKGYLLGGLVWFAVPFSLATSLGLGALALDLPISKDEADRGLVPPATAIALMGKSGSLLLLTMLFMAVTSAGSSELIAVSSLFTYDIYRTYINPRATGRQILKISRCAVLGFGCFMGILAVVLNKAGVSLGWMYLAMGVLIGSAVIPIAFMLLWSKANAFGAILGATSGCVFGIITWLTTAKTQYGRVDLDSTGKNGPMLAGNLVAILTVRPQNYDWSTTREIKVVEAYASGDEDVDVPAEELREEKLRRAKAWIVKWGLVFTILIVVIWPVLSLPARVFSRGYFWFWAIVAIAWGTIGSIVIIGLPLVESWDTIKSVCMGMFTNDRVMKKLDDLNHRLRALTMAVPEAEKIYLLELEKTKKNDEEG

SEQ ID NO: 8079 - protein, 338 aa, Brassica rapa
MGVDYYNVLQVDRNASEDDLKKAYRKLAMKWHPDKNPNNKKDAEAKFKQISEAYEVLSDPQKKAVYDQYGEEGLKGNVPPPDAGGATYFSTGDGPTSFRFNPRSADDIFAEFFGFSRPFGGGGGGGTRFSSSMFGDNIFASFGEAGGGGGAMHHGGGARKAAPIENRLPCSLEDLYKGTTKKMKISREIADVSGKTMPVEEILTIDVKPGWRKGTRITFPEKGNEQPGVTPADLVFIIDEKPHPVFTREGNDLIVTQRISLAEALTGYTVNLTTLDGRRLTIPVTNVIHPEYEEVVPKEGMPLQKDQTKRGNLRIKFKIKFPTRLTSEQKTGVKKLLG

SEQ ID NO: 8080 - protein, 338 aa, Brassica napus
MGVDYYNVLQVDRNASEDDLKKAYRKLAMKWHPDKNPNNKKDAEAKFKQISEAYEVLSDPQKKAVYDQYGEEGLKGNVPPPDAGGATYFATGDGPTSFRFNPRSADDIFAEFFGFSRPFGGGGGGGTRFSSSMFGDNIFASFGEAGGGGGAMHHGGGARKAAPIENRLPCSLEDLYKGTTKKMKISREIADVSGKTMPVEEILTIDVKPGWKKGTRITFPEKGNEQPGVTPADLVFIIDEKPHPVFTREGNDLIVTQRISLAEALTGYTVNLTTLDGRRLTIPVTNVIHPEYEEVVPKEGMPLQKDQTKRGNLRIKFNIKFPTRLTSEQKAGVKKLLG

SEQ ID NO: 8081 - protein, 336 aa, Raphanus sativus
  misc_feature (157)..(157): Xaa can be any naturally occurring amino acid
MGVDYYNVLQVDRNASDDDLKKAYRKLAMKWHPDKNPNNKKDAEAKFKQISEAYEVLSDPQKKAVYDQYGEEGLKGNVPPPDAGGATYFSTGDGPTSFRFNPRSADDVFAEFFGFSGPFGGGGGGTRFSSSMFGDNIFASFGEGGGGGGAMHHSVPXKAAPIENKLPCSLEDLYKGTTKKMKISREIADVSGKTMPVEEILTIDVKPGWKKGTRITFPEKGNEQPGVTPADLVFIIDEKPHPVFTREGNDLVVTQKISLVEALTGCTVNLTTLDGRRLTIPVTSVIHPEYEEVVPKEGMPLQKDQTKRGNLRIKFNIKFPTRLTLEQKTGVKKLLG

SEQ ID NO: 8082 - protein, 337 aa, Arabidopsis thaliana
MGVDYYKVLQVDRSASDDDLKKAYRKLAMKWHPDKNPNNKKDAEAMFKQISEAYEVLSDPQKKAVYDQYGEEGLKGNVPPPDAGGATYFSTGDGPTSFRFNPRNADDIFAEFFGFSSPFGGGRGGTRFSSSMFGDNMFASFGEGGGGGGGSMHHGGARKAAPIENKLPCSLEDLYKGTTKKMRISREIADVSGKTMQVEEILTIDVKPGWKKGTKITFPEKGNEQPGVIPADLVFIIDEKPHPVFTREGNDLIVTQKISLVEALTGYTVNLTTLDGRRLTIPVTNVVHPEYEEVVPKEGMPLQKDQTKRGNLRIKFNIKFPTRLTSEQKTGVKKLLG

SEQ ID NO: 8083 - protein, 339 aa, Arabidopsis lyrata
MGVDYYKVLQVDRNASDDDLKKAYRKLAMKWHPDKNPNNKKDAEAMFKQISEAYEVLSDPQKKAVYDQYGEEGLKGNVPPPDAGGATYFSTGDGPTSFRFNPRNADDIFAEFFGFSSPFGGAGGRGGTRFSSSMFGDDIFASFSEGGGGGGGSMHHGGARKAAPIENKLPCSLEDLYKGTTKKMRISREIADVSGKTMQVEEILTIDVKPGWKKGTKITFPEKGNEQPGVIPADLVFIIDEKPHPVFTREGNDLVVTQKISLVEALTGYTVNLTTLDGRRLTIPVTNVIHPEYEEVVPKEGMPLQKDQTKKGNLRIKFNIKFPTRLTSEQKTGVKKLLG

SEQ ID NO: 8084 - protein, 344 aa, Arabidopsis lyrata
MGVDYYKVLQVDRSANDDDLKKAYRKLAMKWHPDKNPNNKKDAEAKFKQISEAYDVLSDPQKRAVYDQYGEEGLKGNVPPPNAGGGASYFSTGDGPSSFRFNPRSADDIFAEFFGFSTPFGGGGGGQRFASRMFGDDMYASFGEGAGGGGAMHHHHHHHHHGAARKVAPIENKLPCSLEDLYKGTTKKMKISREIVDVSGKAMQVEEILTIGVKPGWKKGTKITFPEKGNEHPGVIPADLVFIIDEKPHPVFTREGNDLIVTQKVSLADALTGYTANITTLDGRTLTIPITNVIHPEYEEVVPKEGMPLQKDQTKKGNLRIKFNIKFPARLTAEQKAGFKKLIG

SEQ ID NO: 8085 - protein, 348 aa, Arachis hypogaea
MGVDYYKVLQVDRNATEDDLKKAYRKLAMKWHPDKNPNNKKEAEAKFKQISEAYDVLSDPQKRAIYDQYGEEGLKGQVPPPDAGSGGGGSTFFSTSDIPGSFRFNPRNADDIFAEFFGFSSPFGGMGRSSGGGMRSRFPNGMFGDDMFASFGEGGGGAGVHMSQGGPRKAPPIENKLPCTLEDIYKGTTKKMKISREIIDASGKTMPVEEILTINVKPGWKKGTKITFPEKGNEQPNVTPADLVFIIDEKPHSVFTREGNDLITTQKISLVEALTGYTVNLTTLDGRNLTIPINSVIHPDYEEVVPREGMPLPKDPSKKGNLRIKFNIKFPSRLSADQKSGIKKLLAG

SEQ ID NO: 8086 - protein, 153 aa, Raphanus sativus
  misc_feature (133)..(133): Xaa can be any naturally occurring amino acid
  misc_feature (136)..(136): Xaa can be any naturally occurring amino acid
MDTESWKFLRSVCLLSFLLGSCFLYQSLHVAIAAQEQDTTQPSVTLQVNDSNGVGRLIPDTLFGIFFEEINHAGAGGLWAELVSNRGFEAGGQNTPSNIWPWSIVGDQSSIYVSTDRSSCFERNKIALGMDVXCDXNGCPSVVLEFITLVTGA

SEQ ID NO: 8087 - protein, 458 aa, Brassica napus
MERKLLLTVSIIMNLVFTIHILYRNSTTWNPTWTSRAAIEAEDAASVSCSGHGRAYVDGIGVLGGKQPSCECNNCYTGKDCSILLSDCPVNANSGDPLFLEPFWMRQAESSAALVSGWHRMSYIYQDGTYMSEALETVIRKLHSVVGNAVTDNRFVIFGSGSTQLLAAAVHALSLTNSSSSGPARLLASVPYYAMYKEQAEFFDSVHLKFEGDAFAWKNSERNDNTTQVIEVVTSPNNPDGKLKRAVLDGPNVKTIHDYAYYWPYFSPITVPADEDLSLFSLSKTTGHAGSRFGWGLVKDKTVYENMKRYITLSSMGVSRTTQLHVLQLLNVVVRDGGDNIFHFGHETLKKRWETVNKVLSLSTRFSLQKIKPEYCNYFKKVRDFAPSYAWVKCERPGDANWYEIFREAKITGRDGKVFGSEESFVRLSLIRSQDDFDHLIDMLKKLVLQEGVEAHSI

SEQ ID NO: 8088 - protein, 458 aa, Brassica napus
  misc_feature (269)..(269): Xaa can be any naturally occurring amino acid
  misc_feature (356)..(356): Xaa can be any naturally occurring amino acid
MERKLLLTVSIIMNLVFTIHILYRNSTTWNPTWTSRAAIEAEDAASVSCSGHGRAYVDGIGVLGGKQPSCECNNCYTGKDCSILLSDCPVNANSGDPLFLEPFWMRQAESSAALVSGWHRMSYIYQDGTYMSEALETVIRKLHSVVGNAVTDNRFVIFGSGSTQLLAAAVHALSLTNSSSSGPARLLASVPYYAMYKEQAEFFDSVHLKFEGDAFAWKNSERNDNTTQVIEVVTSPNNPDGKLKRAVLDGPNVKTIHDYAYYWPYFSPXTVPADEDLSLFSLSKTTGHAGSRFGWGLVKDKTVYENMKRYITLSSMGVSRTTQLHVLQLLNVVVRDGGDNIFHFGHETLKKRWETXNKVLSLSTRFSLQKIKPEYCNYFKKVRDFAPSYAWVKCERPGDANWYEIFREAKITGRDGKVFGSEESFVRLSLIRSQDDFDHLIDMLKKLVLQEGVEAHSI

SEQ ID NO: 8089 - protein, 463 aa, Arabidopsis thaliana
MMQKKLLLIVSIILNLVFTIHILYYSSTTWNPTWTNRAAAEAETVASFSCSGHGRAFVDGLGVLDGQKPPCECNNCYIGKDCSVLLKDCPVDANSGDPLFLEPFWMRQAERSAILVSGWHRMSYIYEDGTYVSRELEKVIRKLHSVVGNAVTDNRFVIFGSGTTQLLAAAVHALSLTNSSVSSPARLLTSIPYYAMYKDQAEFFDSAHLKFEGNASAWKQSGRNDNITQVIEVVTSPNNPDGKLKRAVLDGPNVKTLHDYAYYWPHFSPITHPVDEDLSLFSLSKTTGHAGSRFGWGLVKDKAIYEKMDRFIRLTSMGVSKETQLHVLQLLKVVVGDGGNEIFSFGYGTVKKRWETLNKIFSMSTRFSLQTIKPEYCNYFKKVREFTPSYAWVKCERPEDTNCYEIFRAAKITGRNGNVFGSEERFVRLSLIRSQDDFDQLIAMLKKLVYHEEDVPSENFMYI

SEQ ID NO: 8090 - protein, 246 aa, Brassica napus
MKLKVYADRMSQPSRAVIIFCKVNGIEFDEVLIILAKRQQLSPEFKEINPLGKVPTIVDGRLKLFESHAILIYLSSAFPSVADHWYPNDLSKRAKIHSVLDWHHSNLRPGAAGYVMNSVLAPFLGGSLDSKAAAEAEQILTKSLSTLETFWLKGNAKFLLGSNQPSIADLSLVCELMQLQVLDEKDRLRLFSPYKKVEEWIENTRKATQPHFDVVHKTLYGAKDKFEKQRKMGTTTVSKPGFQSKM

SEQ ID NO: 8091 - protein, 246 aa, Brassica rapa
  misc_feature (228)..(228): Xaa can be any naturally occurring amino acid
MKLKVYADRMSQPSRAVIIFCKVNGIEFDEVLIILAKRQQLSPEFKEINPLGKVPTIVDGRLKLFESHAILIYLSSAFPSVADHWYPNDLSKRAKIHSVLDWHHSNLRPGAAGYVMNSVLAPFLGRSLDSKAAAEAEQILTKSLSTLETFWLKGNAKFLLGSNQLSIADLSLVCELMQLQVLDEKDRLRLFSPYKKVEEWIENTRKATQPHFDVVHKTLYGAKDKFRXQRKMGTTTVSKPGFQSKM

SEQ ID NO: 8092 - DNA, 277 bp, Artificial Sequence
  Single strand DNA oligonucleotide
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 8093 - DNA, 2322 bp, Artificial Sequence
  Single strand DNA oligonucleotide
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 8094 - DNA, 877 bp, Artificial Sequence
  Single strand DNA oligonucleotide
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 8095 - DNA, 1127 bp, Artificial Sequence
  Single strand DNA oligonucleotide
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 8096 - DNA, 2318 bp, Artificial Sequence
  Single strand DNA oligonucleotide
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 8097 - DNA, 1096 bp, Artificial Sequence
  Single strand DNA oligonucleotide
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 8098 - DNA, 21 bp, Artificial Sequence
  Single strand DNA oligonucleotide
tataccagtggagacgaaagc

SEQ ID NO: 8099 - DNA, 24 bp, Artificial Sequence
  Single strand DNA oligonucleotide
taataaatagtcgactctttgggg

SEQ ID NO: 8100 - DNA, 29 bp, Artificial Sequence
  Single strand DNA oligonucleotide
aaaggatccacgcaccgagctttaagaag

SEQ ID NO: 8101 - DNA, 31 bp, Artificial Sequence
  Single strand DNA oligonucleotide
aaaggatccaggagacagagctatttgttcg

SEQ ID NO: 8102 - DNA, 31 bp, Artificial Sequence
  Single strand DNA oligonucleotide
aaaggatccagccactccactaattacaagc

SEQ ID NO: 8103 - DNA, 31 bp, Artificial Sequence
  Single strand DNA oligonucleotide
aaaggatcccctccatttctgatagcttacg

SEQ ID NO: 8104 - DNA, 31 bp, Artificial Sequence
  Single strand DNA oligonucleotide
aaaggatccaacttagggttcgttatcatcg

SEQ ID NO: 8105 - DNA, 30 bp, Artificial Sequence
  Single strand DNA oligonucleotide
aaaggatccctaattccttgcggcttcttc

SEQ ID NO: 8106 - DNA, 31 bp, Artificial Sequence
  Single strand DNA oligonucleotide
aaagtcgacaagcatctttcttgatagcacc

SEQ ID NO: 8107 - DNA, 33 bp, Artificial Sequence
  Single strand DNA oligonucleotide
aaaggatccttacaagatgaaccccaaaatcag

SEQ ID NO: 8108 - DNA, 31 bp, Artificial Sequence
  Single strand DNA oligonucleotide
aaaggatccaattgtgttgttgcatagttcc

SEQ ID NO: 8109 - DNA, 31 bp, Artificial Sequence
  Single strand DNA oligonucleotide
aaaggatccactccgaccactgttacatcac

SEQ ID NO: 8110 - DNA, 31 bp, Artificial Sequence
  Single strand DNA oligonucleotide
aaaggatccctagctcggagtaagctaatcg

SEQ ID NO: 8111 - DNA, 35 bp, Artificial Sequence
  Single strand DNA oligonucleotide
aaagtcgacgagagaaagaagtaagaaatggctac

SEQ ID NO: 8112 - DNA, 30 bp, Artificial Sequence
  Single strand DNA oligonucleotide
aaaggatccgaaaaatgagtggctccgttg

SEQ ID NO: 8113 - DNA, 28 bp, Artificial Sequence
  Single strand DNA oligonucleotide
aaaggatccacgctacaacaatggcgtc

SEQ ID NO: 8114 - DNA, 30 bp, Artificial Sequence
  Single strand DNA oligonucleotide
aaaggatccgtacagccagtcctcgtcttg

SEQ ID NO: 8115 - DNA, 33 bp, Artificial Sequence
  Single strand DNA oligonucleotide
aaaggatcctggaagagaatacaaaatggcaac

SEQ ID NO: 8116 - DNA, 37 bp, Artificial Sequence
  Single strand DNA oligonucleotide
aatgtcgactaaacatggaactaagtatcatgttatg

SEQ ID NO: 8117 - DNA, 33 bp, Artificial Sequence
  Single strand DNA oligonucleotide
aaaggatccacatagaagagacacaccaacaag

SEQ ID NO: 8118 - DNA, 32 bp, Artificial Sequence
  Single strand DNA oligonucleotide
aaagtcgactgagcgaaactatgccatatacc

SEQ ID NO: 8119 - DNA, 29 bp, Artificial Sequence
  Single strand DNA oligonucleotide
aaagtcgaccgctctctccactctgtttc

SEQ ID NO: 8120 - DNA, 31 bp, Artificial Sequence
  Single strand DNA oligonucleotide
aaaggatccgctgaagctaataaacccaatc

SEQ ID NO: 8121 - DNA, 30 bp, Artificial Sequence
  Single strand DNA oligonucleotide
aaaggatcccacagttgttctcatcgaagc

SEQ ID NO: 8122 - DNA, 31 bp, Artificial Sequence
  Single strand DNA oligonucleotide
aaagtcgactcatcttcttccagtgtctgtc

SEQ ID NO: 8123 - DNA, 32 bp, Artificial Sequence
  Single strand DNA oligonucleotide
aaaggatcccatctagagttgagaatggaagg

SEQ ID NO: 8124 - DNA, 32 bp, Artificial Sequence
  Single strand DNA oligonucleotide
aaaggatccccgtaattgtgtctcttctcttc

SEQ ID NO: 8125 - DNA, 31 bp, Artificial Sequence
  Single strand DNA oligonucleotide
aaaggatcctcacgtagcaattttgaagatg

SEQ ID NO: 8126 - DNA, 36 bp, Artificial Sequence
  Single strand DNA oligonucleotide
aaagtcgactttgtaatggcagcacttaaacttatc

SEQ ID NO: 8127 - DNA, 34 bp, Artificial Sequence
  Single strand DNA oligonucleotide
aaaggatcctcctcactttctcactctactttgc

SEQ ID NO: 8128 - DNA, 31 bp, Artificial Sequence
  Single strand DNA oligonucleotide
aaaggatccattaaggttgtggctgcagtag

SEQ ID NO: 8129 - DNA, 27 bp, Artificial Sequence
  Single strand DNA oligonucleotide
aaagtcgaccggatccgtagggtgttg

SEQ ID NO: 8130 - DNA, 31 bp, Artificial Sequence
  Single strand DNA oligonucleotide
aaaggatccgagtgtctctctcccaaatcag

SEQ ID NO: 8131 - DNA, 31 bp, Artificial Sequence
  Single strand DNA oligonucleotide
aaagtcgacttgtaaccacagaactttgcag

SEQ ID NO: 8132 - DNA, 29 bp, Artificial Sequence
  Single strand DNA oligonucleotide
aaaggatcccgagcctgactggagaaatc

SEQ ID NO: 8133 - DNA, 34 bp, Artificial Sequence
  Single strand DNA oligonucleotide
aaaggatccggaagtgctatattgcttcttcttc

SEQ ID NO: 8134 - DNA, 31 bp, Artificial Sequence
  Single strand DNA oligonucleotide
aaaggatccgagatacaaccaagcacaagag

SEQ ID NO: 8135 - DNA, 36 bp, Artificial Sequence
  Single strand DNA oligonucleotide
aaagtcgacagaaacatgactattgctttaacgatc

SEQ ID NO: 8136 - DNA, 31 bp, Artificial Sequence
  Single strand DNA oligonucleotide
aaagtcgacttcgtattctcatcaacaaagc

SEQ ID NO: 8137 - DNA, 31 bp, Artificial Sequence
  Single strand DNA oligonucleotide
aaagtcgacgctcgatctgtgaaggtttctc

SEQ ID NO: 8138 - DNA, 34 bp, Artificial Sequence
  Single strand DNA oligonucleotide
aaaggatccaaaagatggcaaacttgagtacact

SEQ ID NO: 8139 - DNA, 31 bp, Artificial Sequence
  Single strand DNA oligonucleotide
aaaggatccgattgatctcaaatctggttgg

SEQ ID NO: 8140 - DNA, 35 bp, Artificial Sequence
  Single strand DNA oligonucleotide
aaaggatccacaattcacaatcttctttagaatcc

SEQ ID NO: 8141 - DNA, 31 bp, Artificial Sequence
  Single strand DNA oligonucleotide
aaaggatccgtattcttatcgagatgggtgg

SEQ ID NO: 8142 - DNA, 32 bp, Artificial Sequence
  Single strand DNA oligonucleotide
aaaggatccaaaacaaatcaaagtaatggctg

SEQ ID NO: 8143 - DNA, 31 bp, Artificial Sequence
  Single strand DNA oligonucleotide
aaagtcgactgcagctaagaaccagagatag

SEQ ID NO: 8144 - DNA, 31 bp, Artificial Sequence
  Single strand DNA oligonucleotide
aaaggatcctctggtctccttgaagatgaat

SEQ ID NO: 8145 - DNA, 29 bp, Artificial Sequence
  Single strand DNA oligonucleotide
aaaggatcccgctttaaggctcaactctg

SEQ ID NO: 8146 - DNA, 30 bp, Artificial Sequence
  Single strand DNA oligonucleotide
aaaggatccgtggttgggaagatcgagtag

SEQ ID NO: 8147 - DNA, 31 bp, Artificial Sequence
  Single strand DNA oligonucleotide
aaaggatcctgccatacgtcctaaagatagc

SEQ ID NO: 8148 - DNA, 30 bp, Artificial Sequence
  Single strand DNA oligonucleotide
aaaggatccgacgtcactctttctcccttc

SEQ ID NO: 8149 - DNA, 30 bp, Artificial Sequence
  Single strand DNA oligonucleotide
aaaggatccggagagagagagacaagccac

SEQ ID NO: 8150 - DNA, 34 bp, Artificial Sequence
  Single strand DNA oligonucleotide
tttgtcgacgagagaatggatcagatcttgaaca

SEQ ID NO: 8151 - DNA, 32 bp, Artificial Sequence
  Single strand DNA oligonucleotide
aaagtcgacggactagctcaaattctcctgtg

SEQ ID NO: 8152 - DNA, 31 bp, Artificial Sequence
  Single strand DNA oligonucleotide
aaaggatccgagggacttgttcagctactgc

SEQ ID NO: 8153 - DNA, 31 bp, Artificial Sequence
  Single strand DNA oligonucleotide
aaaggatcccatttgtaagtgaacccattcc

SEQ ID NO: 8154 - DNA, 30 bp, Artificial Sequence
  Single strand DNA oligonucleotide
aaaggatcctgactgcttcttctgcatttc

SEQ ID NO: 8155 - DNA, 31 bp, Artificial Sequence
  Single strand DNA oligonucleotide
aaaggatccaggttgacagagctttagttcc

SEQ ID NO: 8156 - DNA, 32 bp, Artificial Sequence
  Single strand DNA oligonucleotide
aaaggatccttgttcaccaaagagaagaagac

SEQ ID NO: 8157 - DNA, 33 bp, Artificial Sequence
  Single strand DNA oligonucleotide
aaaggatcccatttgagaactctagaaacctgc

SEQ ID NO: 8158 - DNA, 28 bp, Artificial Sequence
  Single strand DNA oligonucleotide
aaaggatcctcctgccgaaaagagagag

SEQ ID NO: 8159 - DNA, 32 bp, Artificial Sequence
  Single strand DNA oligonucleotide
aaaggatccaagcaacaagtgaagaaagaaag

SEQ ID NO: 8160 - DNA, 32 bp, Artificial Sequence
  Single strand DNA oligonucleotide
aaaggatcctcgtcttcctcctcctaaatcac

SEQ ID NO: 8161 - DNA, 31 bp, Artificial Sequence
  Single strand DNA oligonucleotide
aaaggatccgaacgtttcagaatcatcaacc

SEQ ID NO: 8162 - DNA, 34 bp, Artificial Sequence
  Single strand DNA oligonucleotide
aaaggatccaaacatcgaaatcttagagaagaag

SEQ ID NO: 8163 - DNA, 27 bp, Artificial Sequence
  Single strand DNA oligonucleotide
aaaggatccgctagggaagggaaggag

SEQ ID NO: 8164 - DNA, 29 bp, Artificial Sequence
  Single strand DNA oligonucleotide
aaaggatccctctctagcctcaacgcctc

SEQ ID NO: 8165 - DNA, 29 bp, Artificial Sequence
  Single strand DNA oligonucleotide
aaaggatcccgagcagtgagaggagatcg

SEQ ID NO: 8166 - DNA, 29 bp, Artificial Sequence
  Single strand DNA oligonucleotide
aaaggatcccgagcttctccctcctaaac

SEQ ID NO: 8167 - DNA, 31 bp, Artificial Sequence
  Single strand DNA oligonucleotide
aaaggatccctacatcgttccaccacctacc

SEQ ID NO: 8168 - DNA, 28 bp, Artificial Sequence
  Single strand DNA oligonucleotide
aaaggatccaaccgaccagctacgcaac

SEQ ID NO: 8169 - DNA, 32 bp, Artificial Sequence
  Single strand DNA oligonucleotide
aaaggatccactttgatcacttcaatggcttc

SEQ ID NO: 8170 - DNA, 31 bp, Artificial Sequence
  Single strand DNA oligonucleotide
aaaggatcccaaactgggtaatcaagaatcc

SEQ ID NO: 8171 - DNA, 29 bp, Artificial Sequence
  Single strand DNA oligonucleotide
aaaggatccgagtaccacattccgaccac

SEQ ID NO: 8172 - DNA, 35 bp, Artificial Sequence
  Single strand DNA oligonucleotide
aaaggatcccagctataaatgctttgttctacagc

SEQ ID NO: 8173 - DNA, 33 bp, Artificial Sequence
  Single strand DNA oligonucleotide
aaaggatccccttacaaacgtacaatcagtgtg

SEQ ID NO: 8174 - DNA, 28 bp, Artificial Sequence
  Single strand DNA oligonucleotide
aaactcgagcaaagctcccatcttttcc

SEQ ID NO: 8175 - DNA, 27 bp, Artificial Sequence
  Single strand DNA oligonucleotide
aaaggatccccaaccatggattccacc

SEQ ID NO: 8176 - DNA, 31 bp, Artificial Sequence
  Single strand DNA oligonucleotide
aaaggatccaaacagaggaagaggtgagatg

SEQ ID NO: 8177 - DNA, 31 bp, Artificial Sequence
  Single strand DNA oligonucleotide
aaagtcgaccgaaacccactaagaatacagc

SEQ ID NO: 8178 - DNA, 27 bp, Artificial Sequence
  Single strand DNA oligonucleotide
tttgatatcacttcgccggaaacaatg

SEQ ID NO: 8179 - DNA, 31 bp, Artificial Sequence
  Single strand DNA oligonucleotide
aaaggatcctgtgttaaagagtcttgcagtg

SEQ ID NO: 8180 - DNA, 27 bp, Artificial Sequence
  Single strand DNA oligonucleotide
aaaggatcccaaagcgaaaatggcagg

SEQ ID NO: 8181 - DNA, 31 bp, Artificial Sequence
  Single strand DNA oligonucleotide
aaagtcgacacagccaatcgttatctcgtag

SEQ ID NO: 8182 - DNA, 33 bp, Artificial Sequence
  Single strand DNA oligonucleotide
aaagtcgacccaaattattcttcacgactcttc

SEQ ID NO: 8183 - DNA, 31 bp, Artificial Sequence
  Single strand DNA oligonucleotide
aaaggatcctcttgaagcttttgtcatgtcg

SEQ ID NO: 8184 - DNA, 33 bp, Artificial Sequence
  Single strand DNA oligonucleotide
aaaggatcctctgaaactctcagtttgtagctc

SEQ ID NO: 8185 - DNA, 31 bp, Artificial Sequence
  Single strand DNA oligonucleotide
aaagtcgaccgattgttctgacctaccaacc

SEQ ID NO: 8186 - DNA, 33 bp, Artificial Sequence
  Single strand DNA oligonucleotide
aaagtcgaccgataacagaagaagaccagatcg

SEQ ID NO: 8187 - DNA, 32 bp, Artificial Sequence
  Single strand DNA oligonucleotide
aaaggatcccgagaaattagggtttaccatcg

SEQ ID NO: 8188 - DNA, 31 bp, Artificial Sequence
  Single strand DNA oligonucleotide
aaaggatccctaatgcacaccatcaatcttc

SEQ ID NO: 8189 - DNA, 33 bp, Artificial Sequence
  Single strand DNA oligonucleotide
aaactcgagatcgagattcttccttgtctgaag

SEQ ID NO: 8190 - DNA, 29 bp, Artificial Sequence
  Single strand DNA oligonucleotide
aaaggatccagaagaaggtcggatgggag

SEQ ID NO: 8191 - DNA, 35 bp, Artificial Sequence
  Single strand DNA oligonucleotide
aaagtcgactcttataggaagctagctacacttgg

SEQ ID NO: 8192 - DNA, 31 bp, Artificial Sequence
  Single strand DNA oligonucleotide
aaacccgggtgtcaccgacctttctctcttc

SEQ ID NO: 8193 - DNA, 35 bp, Artificial Sequence
  Single strand DNA oligonucleotide
aaaggatcccggtcattcttattagagactcatag

SEQ ID NO: 8194 - DNA, 35 bp, Artificial Sequence
  Single strand DNA oligonucleotide
aaaggatccgaatctagttttaccaatatccttcc

SEQ ID NO: 8195 - DNA, 32 bp, Artificial Sequence
  Single strand DNA oligonucleotide
aaagtcgacgaagaaagcttcatatttccagg

SEQ ID NO: 8196 - DNA, 32 bp, Artificial Sequence
  Single strand DNA oligonucleotide
aaagtcgacttcgaaatatcaaaagaaggaac

SEQ ID NO: 8197 - DNA, 31 bp, Artificial Sequence
  Single strand DNA oligonucleotide
aaagtcgacttctcgtcaggtaaagctcaag

SEQ ID NO: 8198 - DNA, 34 bp, Artificial Sequence
  Single strand DNA oligonucleotide
aaaggatcccacattcttctagagagatctgacc

SEQ ID NO: 8199 - DNA, 31 bp, Artificial Sequence
  Single strand DNA oligonucleotide
aaaggatccgcgtttatacaatttgggtttg

SEQ ID NO: 8200 - DNA, 31 bp, Artificial Sequence
  Single strand DNA oligonucleotide
aaagtcgacgagaaaatcaacatcaatggct

SEQ ID NO: 8201 - DNA, 31 bp, Artificial Sequence
  Single strand DNA oligonucleotide
aaaggatcctgtatccaattgagggcattag

SEQ ID NO: 8202 - DNA, 27 bp, Artificial Sequence
  Single strand DNA oligonucleotide
aaagtcgaccgcaatccgaagattctc

SEQ ID NO: 8203 - DNA, 31 bp, Artificial Sequence
  Single strand DNA oligonucleotide
aaaggatccttatgtgtctagccgcagttcc

SEQ ID NO: 8204 - DNA, 36 bp, Artificial Sequence
  Single strand DNA oligonucleotide
aaaggatccgtaaaaatgaattctttgatgatcaag

SEQ ID NO: 8205 - DNA, 30 bp, Artificial Sequence
  Single strand DNA oligonucleotide
aaaggatccgccaatgctttcacattacac

SEQ ID NO: 8206 - DNA, 31 bp, Artificial Sequence
  Single strand DNA oligonucleotide
aaagtcgactcacatcacttcactcggtacg

SEQ ID NO: 8207 - DNA, 32 bp, Artificial Sequence
  Single strand DNA oligonucleotide
aaagtcgacccacattcattagaggatggaag

SEQ ID NO: 8208 - DNA, 32 bp, Artificial Sequence
  Single strand DNA oligonucleotide
aaaggatccggtaggcttggtagatgaaatcg

SEQ ID NO: 8209 - DNA, 35 bp, Artificial Sequence
  Single strand DNA oligonucleotide
aaaggatccccttatactacactttgaaattttgc

SEQ ID NO: 8210 - DNA, 32 bp, Artificial Sequence
  Single strand DNA oligonucleotide
aaaggatcctcaggcactagaaatcaagaaac

SEQ ID NO: 8211 - DNA, 32 bp, Artificial Sequence
  Single strand DNA oligonucleotide
aaaggatccaagattaccagtgtccagtgtgc

SEQ ID NO: 8212 - DNA, 31 bp, Artificial Sequence
  Single strand DNA oligonucleotide
aaagtcgaccaaaccctaatctcatttctgg

SEQ ID NO: 8213 - DNA, 28 bp, Artificial Sequence
  Single strand DNA oligonucleotide
aaaggatccaaacaccgaaagcagttgg

SEQ ID NO: 8214 - DNA, 36 bp, Artificial Sequence
  Single strand DNA oligonucleotide
aaaggatcccatcgaaaaaatgaaaacttttaattg

SEQ ID NO: 8215 - DNA, 35 bp, Artificial Sequence
  Single strand DNA oligonucleotide
aaaggatcctgataatactccataaatggatggga

SEQ ID NO: 8216 - DNA, 32 bp, Artificial Sequence
  Single strand DNA oligonucleotide
aaaggatccccagagtaccaattcatcatcac

SEQ ID NO: 8217 - DNA, 31 bp, Artificial Sequence
  Single strand DNA oligonucleotide
aaaggatccttacaagaccataccgccattc

SEQ ID NO: 8218 - DNA, 31 bp, Artificial Sequence
  Single strand DNA oligonucleotide
aaaggatccagaaacgttaatcaatggcgtc

SEQ ID NO: 8219 - DNA, 33 bp, Artificial Sequence
  Single strand DNA oligonucleotide
aaaggatcctcttacaatggcttcatcaatcac

SEQ ID NO: 8220 - DNA, 32 bp, Artificial Sequence
  Single strand DNA oligonucleotide
aaagtcgacgaaccttcaatatctgctaatgg

SEQ ID NO: 8221 - DNA, 31 bp, Artificial Sequence
  Single strand DNA oligonucleotide
aaaggatcccgaacttgtaggatttcctgtc

SEQ ID NO: 8222 - DNA, 32 bp, Artificial Sequence
  Single strand DNA oligonucleotide
aacgtcgactttcttcaaacaacaaatgtctc

SEQ ID NO: 8223 - DNA, 31 bp, Artificial Sequence
  Single strand DNA oligonucleotide
aaagtcgacggaagacggtttagacagagag

SEQ ID NO: 8224 - DNA, 30 bp, Artificial Sequence
  Single strand DNA oligonucleotide
aaaggatcccactcgatcatttcacctcag

SEQ ID NO: 8225 - DNA, 33 bp, Artificial Sequence
  Single strand DNA oligonucleotide
aaagtcgacctagatctgaaacgaagctatgca

SEQ ID NO: 8226 - DNA, 31 bp, Artificial Sequence
  Single strand DNA oligonucleotide
aaaggatcccagattgaacccaatccaaatc

SEQ ID NO: 8227 - DNA, 31 bp, Artificial Sequence
  Single strand DNA oligonucleotide
aaagtcgaccttgaagcaaattcaacttctg

SEQ ID NO: 8228 - DNA, 31 bp, Artificial Sequence
  Single strand DNA oligonucleotide
aaaggatcctatcgtccatagttcaatcagg

SEQ ID NO: 8229 - DNA, 29 bp, Artificial Sequence
  Single strand DNA oligonucleotide
aaagtcgacctctgttcggttggtttcac

SEQ ID NO: 8230 - DNA, 30 bp, Artificial Sequence
  Single strand DNA oligonucleotide
aaagtcgacagaagaactaggcaacgcatc

SEQ ID NO: 8231 - DNA, 30 bp, Artificial Sequence
  Single strand DNA oligonucleotide
aaacccgggagcttgacgacgatgaatatg

SEQ ID NO: 8232 - DNA, 31 bp, Artificial Sequence
  Single strand DNA oligonucleotide
aaagtcgacaaccctaaaccctaattgatcg

SEQ ID NO: 8233 - DNA, 32 bp, Artificial Sequence
  Single strand DNA oligonucleotide
aaagtcgactccaactccaactaacaacactc

SEQ ID NO: 8234 - DNA, 31 bp, Artificial Sequence
  Single strand DNA oligonucleotide
aaaggatccctcgagagagaagtagcatttg

SEQ ID NO: 8235 - DNA, 31 bp, Artificial Sequence
  Single strand DNA oligonucleotide
aaagtcgactgtgggagttgattgataagag

SEQ ID NO: 8236 - DNA, 31 bp, Artificial Sequence
  Single strand DNA oligonucleotide
aaagtcgacaaacatttagggttcctccttc

SEQ ID NO: 8237 - DNA, 33 bp, Artificial Sequence
  Single strand DNA oligonucleotide
aaaggatcccagaagctatcgtaatcagttctc

SEQ ID NO: 8238 - DNA, 30 bp, Artificial Sequence
  Single strand DNA oligonucleotide
aaaggatcccggagttgataccaaacaagg

SEQ ID NO: 8239 - DNA, 29 bp, Artificial Sequence
  Single strand DNA oligonucleotide
aaagtcgacagacgaatcaaagctccgac

SEQ ID NO: 8240 - DNA, 31 bp, Artificial Sequence
  Single strand DNA oligonucleotide
aaaggatccaaccaactctgcagctaacatc

SEQ ID NO: 8241 - DNA, 31 bp, Artificial Sequence
  Single strand DNA oligonucleotide
aaaggatccaccttctcttcagtttgctcag

SEQ ID NO: 8242 - DNA, 34 bp, Artificial Sequence
  Single strand DNA oligonucleotide
aaaggatccctctacagctaagatctacctcacc

SEQ ID NO: 8243 - DNA, 30 bp, Artificial Sequence
  Single strand DNA oligonucleotide
aaaggatcccttccaggatctggtgaaaac

SEQ ID NO: 8244 - DNA, 34 bp, Artificial Sequence
  Single strand DNA oligonucleotide
aaagtcgacgttaaaagatggctctcgaagtctg

SEQ ID NO: 8245 - DNA, 31 bp, Artificial Sequence
  Single strand DNA oligonucleotide
aaaggatcctgttaccttctccagacaaagc

SEQ ID NO: 8246 - DNA, 32 bp, Artificial Sequence
  Single strand DNA oligonucleotide
aaaggatcctcattatcaaattaagccactcc

SEQ ID NO: 8247 - DNA, 31 bp, Artificial Sequence
  Single strand DNA oligonucleotide
aaaggatccgagacctttgatgagaatcagc

SEQ ID NO: 8248 - DNA, 32 bp, Artificial Sequence
  Single strand DNA oligonucleotide
aaaggatcccccaatttccctaaatcataaag

SEQ ID NO: 8249 - DNA, 32 bp, Artificial Sequence
  Single strand DNA oligonucleotide
aaaggatcctcccaataaaccctaattccttg

SEQ ID NO: 8250 - DNA, 31 bp, Artificial Sequence
  Single strand DNA oligonucleotide
aaagtcgacttatggaagtctcttgatttcg

SEQ ID NO: 8251 - DNA, 31 bp, Artificial Sequence
  Single strand DNA oligonucleotide
aaaggatccctttgagtctcctgtgtgagag

SEQ ID NO: 8252 - DNA, 31 bp, Artificial Sequence
  Single strand DNA oligonucleotide
aaaggatcccttatttcttgaagcagcttgg

SEQ ID NO: 8253 - DNA, 31 bp, Artificial Sequence
  Single strand DNA oligonucleotide
aaaggatcccatgattcggctatagtgtttg

SEQ ID NO: 8254 - DNA, 31 bp, Artificial Sequence
  Single strand DNA oligonucleotide
aaaggatcctaacctcatagtgtcgacatgg

SEQ ID NO: 8255 - DNA, 34 bp, Artificial Sequence
  Single strand DNA oligonucleotide
aaaggatccaaactctccatctctacacgatacg

SEQ ID NO: 8256 - DNA, 35 bp, Artificial Sequence
  Single strand DNA oligonucleotide
aaagtcgacaacagagagaaagaagtaagaaatgg

SEQ ID NO: 8257 - DNA, 27 bp, Artificial Sequence
  Single strand DNA oligonucleotide
aaaggatccgtacgcggggaaagaaac

SEQ ID NO: 8258 - DNA, 31 bp, Artificial Sequence
  Single strand DNA oligonucleotide
aaaggatccacaaagacgagatttcaagacg

SEQ ID NO: 8259 - DNA, 27 bp, Artificial Sequence
  Single strand DNA oligonucleotide
aaaggatccgccgacgctacaacaatg

SEQ ID NO: 8260 - DNA, 31 bp, Artificial Sequence
  Single strand DNA oligonucleotide
aaaggatccttctgtacagccagtcctcgtc

SEQ ID NO: 8261 - DNA, 32 bp, Artificial Sequence
  Single strand DNA oligonucleotide
aaaggatcccttctatgttcgtctacgactcc

SEQ ID NO: 8262 - DNA, 30 bp, Artificial Sequence
  Single strand DNA oligonucleotide
aaaggatcccctttcggtttcgaaattagg

SEQ ID NO: 8263 - DNA, 27 bp, Artificial Sequence
  Single strand DNA oligonucleotide
aaagtcgacccggggacacacctttct

SEQ ID NO: 8264 - DNA, 31 bp, Artificial Sequence
  Single strand DNA oligonucleotide
aaagtcgacaggtagtggttgtgagcgaaac

SEQ ID NO: 8265 - DNA, 29 bp, Artificial Sequence
  Single strand DNA oligonucleotide
aaagtcgacctgttcttcgctctctccac

SEQ ID NO: 8266 - DNA, 31 bp, Artificial Sequence
  Single strand DNA oligonucleotide
aaaggatccgatccagtagcagaagctgaag

SEQ ID NO: 8267 - DNA, 30 bp, Artificial Sequence
  Single strand DNA oligonucleotide
aaaggatccagttgagcgagtgagtcacag

SEQ ID NO: 8268 - DNA, 36 bp, Artificial Sequence
  Single strand DNA oligonucleotide
aaaggatccatttacatttcgtcaaacttagccttc

SEQ ID NO: 8269 - DNA, 31 bp, Artificial Sequence
  Single strand DNA oligonucleotide
aaagtcgacggcgaagtttctccattaattc

SEQ ID NO: 8270 - DNA, 31 bp, Artificial Sequence
  Single strand DNA oligonucleotide
aaagtcgacagaaggtgtgaactggctactg

SEQ ID NO: 8271 - DNA, 32 bp, Artificial Sequence
  Single strand DNA oligonucleotide
aaaggatcctgtcttcctaatccgtaattgtg

SEQ ID NO: 8272 - DNA, 31 bp, Artificial Sequence
  Single strand DNA oligonucleotide
aaaggatccgaatcccactaacatcgtcttc

SEQ ID NO: 8273 - DNA, 32 bp, Artificial Sequence
  Single strand DNA oligonucleotide
aaaggatccgaacgccttctttctctctcttc

SEQ ID NO: 8274 - DNA, 31 bp, Artificial Sequence
  Single strand DNA oligonucleotide
aaaggatcctgttacttccgggtgatctaag

SEQ ID NO: 8275 - DNA, 31 bp, Artificial Sequence
  Single strand DNA oligonucleotide
aaaggatcctctttggctttaaacctttgtg

SEQ ID NO: 8276 - DNA, 31 bp, Artificial Sequence
  Single strand DNA oligonucleotide
aaagtcgacctcattctcttcgcttgtaacc

SEQ ID NO: 8277 - DNA, 31 bp, Artificial Sequence
  Single strand DNA oligonucleotide
aaaggatccaatcctgtcagaagtaccggag

SEQ ID NO: 8278 - DNA, 31 bp, Artificial Sequence
  Single strand DNA oligonucleotide
aaaggatccaatccagaagaagaggaagtgc

SEQ ID NO: 8279 - DNA, 32 bp, Artificial Sequence
  Single strand DNA oligonucleotide
aaagtcgactgcagtcagtctatttgttgctc

SEQ ID NO: 8280 - DNA, 35 bp, Artificial Sequence
  Single strand DNA oligonucleotide
aaaggatcccattagtgaagtgagatacaaccaag

SEQ ID NO: 8281 - DNA, 31 bp, Artificial Sequence
  Single strand DNA oligonucleotide
aaaggatccagaacaaccacaaaggtgtttc

SEQ ID NO: 8282 - DNA, 33 bp, Artificial Sequence
  Single strand DNA oligonucleotide
aaaggatccatcataaaactcacctcttcccag

SEQ ID NO: 8283 - DNA, 31 bp, Artificial Sequence
  Single strand DNA oligonucleotide
aaagtcgactgattaagctttcgtcgtctcc

SEQ ID NO: 8284 - DNA, 31 bp, Artificial Sequence
  Single strand DNA oligonucleotide
aaaggatccaaaacagaacagagatgggttt

SEQ ID NO: 8285 - DNA, 33 bp, Artificial Sequence
  Single strand DNA oligonucleotide
aaaggatcccactcatacaaaaagatggcaaac

SEQ ID NO: 8286 - DNA, 31 bp, Artificial Sequence
  Single strand DNA oligonucleotide
aaaggatccttgagatctgctttgttcattc

SEQ ID NO: 8287 - DNA, 31 bp, Artificial Sequence
  Single strand DNA oligonucleotide
aaaggatccaccgtaagcgaactattgaatc

SEQ ID NO: 8288 - DNA, 27 bp, Artificial Sequence
  Single strand DNA oligonucleotide
aaaggatccaatcgttcgcgttgagac

SEQ ID NO: 8289 - DNA, 35 bp, Artificial Sequence
  Single strand DNA oligonucleotide
aaaggatccaaattagggtttgtattcttatcgag

SEQ ID NO: 8290 - DNA, 29 bp, Artificial Sequence
  Single strand DNA oligonucleotide
aaactcgagacttcgttacgcggacagtg

SEQ ID NO: 8291 - DNA, 31 bp, Artificial Sequence
  Single strand DNA oligonucleotide
aaaggatccacatacacacccacatgcttac

SEQ ID NO: 8292 - DNA, 31 bp, Artificial Sequence
  Single strand DNA oligonucleotide
aaagtcgactctaccgtctcttcttcaaacc

SEQ ID NO: 8293 - DNA, 30 bp, Artificial Sequence
  Single strand DNA oligonucleotide
aaaggatccgattagctcaagcctcaaggt

SEQ ID NO: 8294 - DNA, 29 bp, Artificial Sequence
  Single strand DNA oligonucleotide
aaaggatccgcacatcgtgaaacaacaac

SEQ ID NO: 8295 - DNA, 31 bp, Artificial Sequence
  Single strand DNA oligonucleotide
aaaggatcccctatttcgtctttactcgacc

SEQ ID NO: 8296 - DNA, 32 bp, Artificial Sequence
  Single strand DNA oligonucleotide
aaaggatccaacaatggctacgaaaccaggca

SEQ ID NO: 8297 - DNA, 35 bp, Artificial Sequence
  Single strand DNA oligonucleotide
aaagtcgacacattctacagtttcatgatttcagc

SEQ ID NO: 8298 - DNA, 32 bp, Artificial Sequence
  Single strand DNA oligonucleotide
aaaggatccatttagggtttctcttcatcgag

SEQ ID NO: 8299 - DNA, 30 bp, Artificial Sequence
  Single strand DNA oligonucleotide
aaaggatccagtccctttctcttgcttcag

SEQ ID NO: 8300 - DNA, 31 bp, Artificial Sequence
  Single strand DNA oligonucleotide
aaaggatccgatcgtcttgttcaccaaagag

SEQ ID NO: 8301 - DNA, 31 bp, Artificial Sequence
  Single strand DNA oligonucleotide
aaaggatccctattgtttcgagtgacccaac

SEQ ID NO: 8302 - DNA, 31 bp, Artificial Sequence
  Single strand DNA oligonucleotide
aaaggatccgcgaagtaaccatttctctcac

SEQ ID NO: 8303 - DNA, 31 bp, Artificial Sequence
  Single strand DNA oligonucleotide
aaaggatcctctaattaacgacaacacgacg

SEQ ID NO: 8304 - DNA, 32 bp, Artificial Sequence
  Single strand DNA oligonucleotide
aaaggatcctctcactctctccgtagtctgag

SEQ ID NO: 8305 - DNA, 31 bp, Artificial Sequence
  Single strand DNA oligonucleotide
aaaggatcctagaagacgaagaacgtttcag

SEQ ID NO: 8306 - DNA, 27 bp, Artificial Sequence
  Single strand DNA oligonucleotide
aaaggatcccttccgtccttgagccac

SEQ ID NO: 8307 - DNA, 29 bp, Artificial Sequence
  Single strand DNA oligonucleotide
aaaggatccaaacaccgctcaaacagaag

SEQ ID NO: 8308 - DNA, 36 bp, Artificial Sequence
  Single strand DNA oligonucleotide
aaaggatcccatcttcaacttcactttgatcacttc

SEQ ID NO: 8309 - DNA, 32 bp, Artificial Sequence
  Single strand DNA oligonucleotide
aaaggatcccacatcttcacaaagttctttcc

SEQ ID NO: 8310 - DNA, 31 bp, Artificial Sequence
  Single strand DNA oligonucleotide
aaaggatcctaaagagtaccacattccgacc

SEQ ID NO: 8311 - DNA, 30 bp, Artificial Sequence
  Single strand DNA oligonucleotide
aaaggatccgcgcaagtaaaccttacaaac

SEQ ID NO: 8312 - DNA, 32 bp, Artificial Sequence
  Single strand DNA oligonucleotide
aaaggatcccgatcacaaattcagaagaaaag

SEQ ID NO: 8313 - DNA, 31 bp, Artificial Sequence
  Single strand DNA oligonucleotide
aaagtcgaccagaaacagagcttgctttacc

SEQ ID NO: 8314 - DNA, 31 bp, Artificial Sequence
  Single strand DNA oligonucleotide
aaaggatcctgagttataacgtttcggcttc

SEQ ID NO: 8315 - DNA, 32 bp, Artificial Sequence
  Single strand DNA oligonucleotide
aaaggatcctggaatgtgttaaagagtcttgc

SEQ ID NO: 8316 - DNA, 35 bp, Artificial Sequence
  Single strand DNA oligonucleotide
aaagtcgaccttaagaactaagcaaagatcccatc

SEQ ID NO: 8317 - DNA, 30 bp, Artificial Sequence
  Single strand DNA oligonucleotide
aaaggatccgaaacaaagcgaaaatggcag

SEQ ID NO: 8318 - DNA, 28 bp, Artificial Sequence
  Single strand DNA oligonucleotide
aaaggatccatcgtcgttcgattcaaag

SEQ ID NO: 8319 - DNA, 34 bp, Artificial Sequence
  Single strand DNA oligonucleotide
aaaggatccttaaaaatggcgatgataggcttac

SEQ ID NO: 8320 - DNA, 32 bp, Artificial Sequence
  Single strand DNA oligonucleotide
aaagtcgacaaacccaaattattcttcacgac

SEQ ID NO: 8321 - DNA, 35 bp, Artificial Sequence
  Single strand DNA oligonucleotide
aaaggatccatattcttgaagcttttgtcatgtcg

SEQ ID NO: 8322 - DNA, 28 bp, Artificial Sequence
  Single strand DNA oligonucleotide
tttaggcctgtagccatgcttcgaactg

SEQ ID NO: 8323 - DNA, 35 bp, Artificial Sequence
  Single strand DNA oligonucleotide
aaagtcgacctgtgagagtgttcttacgtcttacg

SEQ ID NO: 8324 - DNA, 27 bp, Artificial Sequence
  Single strand DNA oligonucleotide
aaaggatcctgcgcctctctctgaaac

SEQ ID NO: 8325 - DNA, 31 bp, Artificial Sequence
  Single strand DNA oligonucleotide
aaagtcgacaaccctagtagccacagagacg

SEQ ID NO: 8326 - DNA, 31 bp, Artificial Sequence
  Single strand DNA oligonucleotide
aaagatatctgcaactgaattagcagaggag

SEQ ID NO: 8327 - DNA, 29 bp, Artificial Sequence
  Single strand DNA oligonucleotide
aaagtcgacggagcagaggaggacatagc

SEQ ID NO: 8328 - DNA, 36 bp, Artificial Sequence
  Single strand DNA oligonucleotide
aaaggatccagacaatgttctgagagagaaacagag

SEQ ID NO: 8329 - DNA, 30 bp, Artificial Sequence
  Single strand DNA oligonucleotide
aaaggatcccacggtggctcttggtttatc

SEQ ID NO: 8330 - DNA, 32 bp, Artificial Sequence
  Single strand DNA oligonucleotide
aaaggatccaaatctaatgcacaccatcaatc

SEQ ID NO: 8331 - DNA, 32 bp, Artificial Sequence
  Single strand DNA oligonucleotide
aaaggatccgcgaaagagagaagaagaaggtc

SEQ ID NO: 8332 - DNA, 30 bp, Artificial Sequence
  Single strand DNA oligonucleotide
aaacccggggttgcagaagttgtcaccgac

SEQ ID NO: 8333 - DNA, 31 bp, Artificial Sequence
  Single strand DNA oligonucleotide
aaaggatccataacaagctaagcggtcattc

SEQ ID NO: 8334 - DNA, 32 bp, Artificial Sequence
  Single strand DNA oligonucleotide
aaaggatccggggaaatatcaaagacgaatac

SEQ ID NO: 8335 - DNA, 33 bp, Artificial Sequence
  Single strand DNA oligonucleotide
aaagtcgacttagcattgaggaagaagaagaag

SEQ ID NO: 8336 - DNA, 35 bp, Artificial Sequence
  Single strand DNA oligonucleotide
aaaggatccgaagaagatgaagctgaaagtgtatg

SEQ ID NO: 8337 - DNA, 31 bp, Artificial Sequence
  Single strand DNA oligonucleotide
aaagtcgacgaaagaagtgcgtgagtgtatg

SEQ ID NO: 8338 - DNA, 33 bp, Artificial Sequence
  Single strand DNA oligonucleotide
aaaggatcctgctcaaagtaacttctcacattc

SEQ ID NO: 8339 - DNA, 36 bp, Artificial Sequence
  Single strand DNA oligonucleotide
aaaggatccggatagctaaaaatggtgagaaatagg

SEQ ID NO: 8340 - DNA, 31 bp, Artificial Sequence
  Single strand DNA oligonucleotide
aaaggatccatccaatttcctcttgatttcc

SEQ ID NO: 8341 - DNA, 31 bp, Artificial Sequence
  Single strand DNA oligonucleotide
aaagtcgaccttcaattgcagagaaaatcaa

SEQ ID NO: 8342 - DNA, 31 bp, Artificial Sequence
  Single strand DNA oligonucleotide
aaaggatcctagtgggatattctgatgcttg

SEQ ID NO: 8343 - DNA, 28 bp, Artificial Sequence
  Single strand DNA oligonucleotide
aaagtcgacaatttcccaccaaagcatc

SEQ ID NO: 8344 - DNA, 31 bp, Artificial Sequence
  Single strand DNA oligonucleotide
aaaggatccacgcgtgcattaattatgtgtc

SEQ ID NO: 8345 - DNA, 30 bp, Artificial Sequence
  Single strand DNA oligonucleotide
tttggatccgggtttggatctgaattgacg

SEQ ID NO: 8346 - DNA, 36 bp, Artificial Sequence
  Single strand DNA oligonucleotide
aaaggatccacctccatttctttatatagcattctc

SEQ ID NO: 8347 - DNA, 29 bp, Artificial Sequence
  Single strand DNA oligonucleotide
aaaggatccatactttctcacgccaatgc

SEQ ID NO: 8348 - DNA, 32 bp, Artificial Sequence
  Single strand DNA oligonucleotide
aaagtcgactcctattcacatcacttcactcg

SEQ ID NO: 8349 - DNA, 31 bp, Artificial Sequence
  Single strand DNA oligonucleotide
aaaggatcccttcgatttgcctaattctcag

SEQ ID NO: 8350 - DNA, 36 bp, Artificial Sequence
  Single strand DNA oligonucleotide
aaagtcgacaactaaattcaccacattcattagagg

SEQ ID NO: 8351 - DNA, 35 bp, Artificial Sequence
  Single strand DNA oligonucleotide
aaaggatccaagaggtaggcttggtagatgaaatc

SEQ ID NO: 8352 - DNA, 27 bp, Artificial Sequence
  Single strand DNA oligonucleotide
aaaggatccatcccgatttctccaagc

SEQ ID NO: 8353 - DNA, 31 bp, Artificial Sequence
  Single strand DNA oligonucleotide
aaaggatcccaatcgaagcttcttctgcaag

SEQ ID NO: 8354 - DNA, 36 bp, Artificial Sequence
  Single strand DNA oligonucleotide
aaaggatccaaagagaccaaaacccttatactacac

SEQ ID NO: 8355 - DNA, 32 bp, Artificial Sequence
  Single strand DNA oligonucleotide
aaaggatcctgcttcattctatctccactttg

SEQ ID NO: 8356 - DNA, 31 bp, Artificial Sequence
  Single strand DNA oligonucleotide
aaagtcgaccgcgtacacgttctacataatc

SEQ ID NO: 8357 - DNA, 31 bp, Artificial Sequence
  Single strand DNA oligonucleotide
aaagtcgacgggttctactgctgtctttgtg

SEQ ID NO: 8358 - DNA, 36 bp, Artificial Sequence
  Single strand DNA oligonucleotide
tttggatccttcatagcaagttttttcctcatagac

SEQ ID NO: 8359 - DNA, 31 bp, Artificial Sequence
  Single strand DNA oligonucleotide
aaaggatccagttggagaaccacgttagcag

SEQ ID NO: 8360 - DNA, 31 bp, Artificial Sequence
  Single strand DNA oligonucleotide
aaagtcgactaatctccatttcattccttcg

SEQ ID NO: 8361 - DNA, 31 bp, Artificial Sequence
  Single strand DNA oligonucleotide
aaaggatccattcttctaacattcgccggaa

SEQ ID NO: 8362 - DNA, 31 bp, Artificial Sequence
  Single strand DNA oligonucleotide
aaaggatcctcaaaccaactattcagcaatc

SEQ ID NO: 8363 - DNA, 31 bp, Artificial Sequence
  Single strand DNA oligonucleotide
aaaggatcctggctttcgtaaactccatttc

SEQ ID NO: 8364 - DNA, 33 bp, Artificial Sequence
  Single strand DNA oligonucleotide
aaagtcgaccccacaaacacaaagtgtaatatc

SEQ ID NO: 8365 - DNA, 31 bp, Artificial Sequence
  Single strand DNA oligonucleotide
aaaggatccgctacatccagatttcctcatc

SEQ ID NO: 8366 - DNA, 34 bp, Artificial Sequence
  Single strand DNA oligonucleotide
aaagtcgacagaaagcaaacagagaaaatgtgtg

SEQ ID NO: 8367 - DNA, 35 bp, Artificial Sequence
  Single strand DNA oligonucleotide
aaaggatccaaaagatggcttctaacacattgatg

SEQ ID NO: 8368 - DNA, 31 bp, Artificial Sequence
  Single strand DNA oligonucleotide
aaaggatcctgtatttgagggttggaaagag

SEQ ID NO: 8369 - DNA, 31 bp, Artificial Sequence
  Single strand DNA oligonucleotide
aaagtcgacgtgaaattctgaagccactagg

SEQ ID NO: 8370 - DNA, 31 bp, Artificial Sequence
  Single strand DNA oligonucleotide
aaaggatcccggtactctcaaattgatcctc

SEQ ID NO: 8371 - DNA, 31 bp, Artificial Sequence
  Single strand DNA oligonucleotide
aaaggatccgatgctagttacggtggtgaag

SEQ ID NO: 8372 - DNA, 31 bp, Artificial Sequence
  Single strand DNA oligonucleotide
aaaggatcccctacaactcaaattctccctc

SEQ ID NO: 8373 - DNA, 31 bp, Artificial Sequence
  Single strand DNA oligonucleotide
aaaggatccagcttctccttcgtccaaattc

SEQ ID NO: 8374 - DNA, 30 bp, Artificial Sequence
  Single strand DNA oligonucleotide
aaaggatccaaggaagccaagcctagaaac

SEQ ID NO: 8375 - DNA, 31 bp, Artificial Sequence
  Single strand DNA oligonucleotide
aaaggatccgcgaattattaaacctctgtgc

SEQ ID NO: 8376 - DNA, 29 bp, Artificial Sequence
  Single strand DNA oligonucleotide
aaagtcgacagtcacggtcttctctctgc

SEQ ID NO: 8377 - DNA, 31 bp, Artificial Sequence
  Single strand DNA oligonucleotide
aaagtcgactcgccactacctaatcataacc

SEQ ID NO: 8378 - DNA, 33 bp, Artificial Sequence
  Single strand DNA oligonucleotide
aaacccggggttagagaagagaagagcttgacg

SEQ ID NO: 8379 - DNA, 27 bp, Artificial Sequence
  Single strand DNA oligonucleotide
aaaggatcccccaatctccaatggcaa

SEQ ID NO: 8380 - DNA, 32 bp, Artificial Sequence
  Single strand DNA oligonucleotide
aaagtcgaccattgaaccctaaaccctaattg

SEQ ID NO: 8381 - DNA, 31 bp, Artificial Sequence
  Single strand DNA oligonucleotide
aaagtcgactccaactccaactccaactaac

SEQ ID NO: 8382 - DNA, 30 bp, Artificial Sequence
  Single strand DNA oligonucleotide
aaagtcgactcagcagttgattctaggacg

SEQ ID NO: 8383 - DNA, 31 bp, Artificial Sequence
  Single strand DNA oligonucleotide
aaagtcgacgaatcgaatcgaaacatttagg

SEQ ID NO: 8384 - DNA, 35 bp, Artificial Sequence
  Single strand DNA oligonucleotide
aaaggatccaaatcagaagctatcgtaatcagttc

SEQ ID NO: 8385 - DNA, 31 bp, Artificial Sequence
  Single strand DNA oligonucleotide
aaaggatcccacctcaccttacctaagaacg

SEQ ID NO: 8386 - DNA, 32 bp, Artificial Sequence
  Single strand DNA oligonucleotide
aaaggatccgaattaagaaaccctagacgacg

SEQ ID NO: 8387 - DNA, 31 bp, Artificial Sequence
  Single strand DNA oligonucleotide
aaaggatcccgaaccattcacagacactaac

SEQ ID NO: 8388 - DNA, 31 bp, Artificial Sequence
  Single strand DNA oligonucleotide
aaaggatcctagaaagcaagaaacttccagg

SEQ ID NO: 8389 - DNA, 30 bp, Artificial Sequence
  Single strand DNA oligonucleotide
aaagtcgacaacaaccatcggtaacaccac

SEQ ID NO: 8390 - DNA, 34 bp, Artificial Sequence
  Single strand DNA oligonucleotide
aaactcgagctaatcactcggacctctctgtctc

SEQ ID NO: 8391 - DNA, 31 bp, Artificial Sequence
  Single strand DNA oligonucleotide
aaaggtacctaccacaccttacaaactccag

SEQ ID NO: 8392 - DNA, 32 bp, Artificial Sequence
  Single strand DNA oligonucleotide
aaactcgagttgctgctcacaacaatagtaag

SEQ ID NO: 8393 - DNA, 30 bp, Artificial Sequence
  Single strand DNA oligonucleotide
aaaggtaccagggatgctcaagagagaaag

SEQ ID NO: 8394 - DNA, 32 bp, Artificial Sequence
  Single strand DNA oligonucleotide
aaactcgagaacaaattgaaacttgctagtgc

SEQ ID NO: 8395 - DNA, 36 bp, Artificial Sequence
  Single strand DNA oligonucleotide
aaaggtacctgtttaaaattccaaatatctcaaagc

SEQ ID NO: 8396 - DNA, 36 bp, Artificial Sequence
  Single strand DNA oligonucleotide
aaagaattccattctctcatgtttcactttataacc

SEQ ID NO: 8397 - DNA, 32 bp, Artificial Sequence
  Single strand DNA oligonucleotide
aaaggtaccgcattcttgatcaaacccttgac

SEQ ID NO: 8398 - DNA, 31 bp, Artificial Sequence
  Single strand DNA oligonucleotide
aaaggtacccattgctgcgacataacaatac

SEQ ID NO: 8399 - DNA, 32 bp, Artificial Sequence
  Single strand DNA oligonucleotide
aaactcgagtaaagggatcaaatgaggagagg

SEQ ID NO: 8400 - DNA, 32 bp, Artificial Sequence
  Single strand DNA oligonucleotide
aaaggtaccaacaatagtcgttctgaaactcg

SEQ ID NO: 8401 - DNA, 33 bp, Artificial Sequence
  Single strand DNA oligonucleotide
aaagaattcgttcatgatttatctcacgttacc

SEQ ID NO: 8402 - DNA, 33 bp, Artificial Sequence
  Single strand DNA oligonucleotide
aaactcgagttattagagatcacaggccgtaag

SEQ ID NO: 8403 - DNA, 33 bp, Artificial Sequence
  Single strand DNA oligonucleotide
tttctcgagtcaagattcaattcaagccgatgg

SEQ ID NO: 8404 - DNA, 35 bp, Artificial Sequence
  Single strand DNA oligonucleotide
aaactcgagctaaatgagaatgctactgtgtggtg

SEQ ID NO: 8405 - DNA, 35 bp, Artificial Sequence
  Single strand DNA oligonucleotide
aaactcgagcattaaataaagatcaccaagtgacg

SEQ ID NO: 8406 - DNA, 32 bp, Artificial Sequence
  Single strand DNA oligonucleotide
aaactcgagttacataatgcgggaaaacagag

SEQ ID NO: 8407 - DNA, 36 bp, Artificial Sequence
  Single strand DNA oligonucleotide
aaagaattcctatggctgatcaatcttatgttgaag

SEQ ID NO: 8408 - DNA, 38 bp, Artificial Sequence
  Single strand DNA oligonucleotide
tttctcgagttattatatggaagaatgtagctgctttg

SEQ ID NO: 8409 - DNA, 31 bp, Artificial Sequence
  Single strand DNA oligonucleotide
aaagaattccaattacggtcatgatgtggtc

SEQ ID NO: 8410 - DNA, 32 bp, Artificial Sequence
  Single strand DNA oligonucleotide
aaactcgagtggaagcaaataataccaatttc

SEQ ID NO: 8411 - DNA, 30 bp, Artificial Sequence
  Single strand DNA oligonucleotide
aaaggtaccccttgtttaacggccaactac

SEQ ID NO: 8412 - DNA, 31 bp, Artificial Sequence
  Single strand DNA oligonucleotide
aaagaattcaattaaacatggaaccacaagc

SEQ ID NO: 8413 - DNA, 28 bp, Artificial Sequence
  Single strand DNA oligonucleotide
aaaggtacctggtgaattgcaatcaagg

SEQ ID NO: 8414 - DNA, 31 bp, Artificial Sequence
  Single strand DNA oligonucleotide
aaactcgagaaatctgaagcactcaacagtc

SEQ ID NO: 8415 - DNA, 30 bp, Artificial Sequence
  Single strand DNA oligonucleotide
aaaggtaccctacatggaatgcagcttttg

SEQ ID NO: 8416 - DNA, 34 bp, Artificial Sequence
  Single strand DNA oligonucleotide
tttgaattcagacagagattaaagcatccacatc

SEQ ID NO: 8417 - DNA, 36 bp, Artificial Sequence
  Single strand DNA oligonucleotide
aaactcgagctaccaacaataaacatgagagccaac

SEQ ID NO: 8418 - DNA, 31 bp, Artificial Sequence
  Single strand DNA oligonucleotide
aaactcgagaaagttcaaggaccacaaagag

SEQ ID NO: 8419 - DNA, 31 bp, Artificial Sequence
  Single strand DNA oligonucleotide
aaagaattccaaccaacagctagcacagaag

SEQ ID NO: 8420 - DNA, 31 bp, Artificial Sequence
  Single strand DNA oligonucleotide
aaaggtaccaattgcacttgtagcctctttc

SEQ ID NO: 8421 - DNA, 31 bp, Artificial Sequence
  Single strand DNA oligonucleotide
aaaggtacccacccaacaagtaggctgtttc

SEQ ID NO: 8422 - DNA, 34 bp, Artificial Sequence
  Single strand DNA oligonucleotide
aaaggtaccctaacataattgaaattcccgaaac

SEQ ID NO: 8423 - DNA, 31 bp, Artificial Sequence
  Single strand DNA oligonucleotide
aaactcgagaacgagcgacaaacaaatctac

SEQ ID NO: 8424 - DNA, 36 bp, Artificial Sequence
  Single strand DNA oligonucleotide
tttgaattctcacttattgcttcttcaagcgtaagg

SEQ ID NO: 8425 - DNA, 34 bp, Artificial Sequence
  Single strand DNA oligonucleotide
aaaggatccttatcattcaacacaagaacacatc

SEQ ID NO: 8426 - DNA, 31 bp, Artificial Sequence
  Single strand DNA oligonucleotide
aaagaattcttctcaaggtttccacgatttg

SEQ ID NO: 8427 - DNA, 31 bp, Artificial Sequence
  Single strand DNA oligonucleotide
tttctcgagctctagcctggattttcaaacg

SEQ ID NO: 8428 - DNA, 29 bp, Artificial Sequence
  Single strand DNA oligonucleotide
aaactcgagcatgaacaagaatcagccac

SEQ ID NO: 8429 - DNA, 31 bp, Artificial Sequence
  Single strand DNA oligonucleotide
aaactcgagctatagtggcgacaattcatcc

SEQ ID NO: 8430 - DNA, 33 bp, Artificial Sequence
  Single strand DNA oligonucleotide
aaactcgaggatccatacatttacactggaatc

SEQ ID NO: 8431 - DNA, 36 bp, Artificial Sequence
  Single strand DNA oligonucleotide
aaactcgagctactcccgttcaataataataaccag

SEQ ID NO: 8432 - DNA, 31 bp, Artificial Sequence
  Single strand DNA oligonucleotide
aaagaattcccgacaaatctacaagagttcc

SEQ ID NO: 8433 - DNA, 36 bp, Artificial Sequence
  Single strand DNA oligonucleotide
aaactcgaggaaagaactaaatcatataagaagcga

SEQ ID NO: 8434 - DNA, 36 bp, Artificial Sequence
  Single strand DNA oligonucleotide
aaactcgagaaacaccacactacatacataactttg

SEQ ID NO: 8435 - DNA, 31 bp, Artificial Sequence
  Single strand DNA oligonucleotide
aaactcgagacgacatttcttacaaacatgc

SEQ ID NO: 8436 - DNA, 35 bp, Artificial Sequence
  Single strand DNA oligonucleotide
aaactcgagctaaaagctgagagagatagggtacg

SEQ ID NO: 8437 - DNA, 34 bp, Artificial Sequence
  Single strand DNA oligonucleotide
aaactcgagacgtaaattacactccatatgatgc

SEQ ID NO: 8438 - DNA, 31 bp, Artificial Sequence
  Single strand DNA oligonucleotide
aaactcgagggattccaactaaagacctctg

SEQ ID NO: 8439 - DNA, 32 bp, Artificial Sequence
  Single strand DNA oligonucleotide
ttcggatcctcatgaacaccagagttaattgc

SEQ ID NO: 8440 - DNA, 36 bp, Artificial Sequence
  Single strand DNA oligonucleotide
aaagtcgacctaaccatataagccgagaaagaaacc

SEQ ID NO: 8441 - DNA, 31 bp, Artificial Sequence
  Single strand DNA oligonucleotide
aaactcgagagccggtgaataattaatgctg

SEQ ID NO: 8442 - DNA, 31 bp, Artificial Sequence
  Single strand DNA oligonucleotide
aaactcgagtacacaaatgcaaatcttgtcc

SEQ ID NO: 8443 - DNA, 31 bp, Artificial Sequence
  Single strand DNA oligonucleotide
aaactcgaggattcagcaacaaagcttcatc

SEQ ID NO: 8444 - DNA, 31 bp, Artificial Sequence
  Single strand DNA oligonucleotide
aaactcgagaaacgaattgcttcaaactagc

SEQ ID NO: 8445 - DNA, 31 bp, Artificial Sequence
  Single strand DNA oligonucleotide
aaactcgagttcacagattcagacaagcatc

SEQ ID NO: 8446 - DNA, 38 bp, Artificial Sequence
  Single strand DNA oligonucleotide
aaactcgagctatgatagtctaaaggaaagagtgtttg

SEQ ID NO: 8447 - DNA, 32 bp, Artificial Sequence
  Single strand DNA oligonucleotide
aaactcgagcttcaacaaacaagacacaacac

SEQ ID NO: 8448 - DNA, 32 bp, Artificial Sequence
  Single strand DNA oligonucleotide
aaactcgaggatacatgaaacaacccttatgc

SEQ ID NO: 8449 - DNA, 35 bp, Artificial Sequence
  Single strand DNA oligonucleotide
aaaggtaccttcaaacctctatggtctgtttaatg

SEQ ID NO: 8450 - DNA, 34 bp, Artificial Sequence
  Single strand DNA oligonucleotide
aaaggtacccaatgttgtgaagttgtattcaaag

SEQ ID NO: 8451 - DNA, 35 bp, Artificial Sequence
  Single strand DNA oligonucleotide
aaactcgagctaaggatcaaagaggtgaaacaaag

SEQ ID NO: 8452 - DNA, 31 bp, Artificial Sequence
  Single strand DNA oligonucleotide
aaactcgagtacttctgcgagtgcctatttc

SEQ ID NO: 8453 - DNA, 31 bp, Artificial Sequence
  Single strand DNA oligonucleotide
aaactcgagtccacgcacataatcaaggtag

SEQ ID NO: 8454 - DNA, 31 bp, Artificial Sequence
  Single strand DNA oligonucleotide
aaactcgagcagaggaactgaattccagcag

SEQ ID NO: 8455 - DNA, 31 bp, Artificial Sequence
  Single strand DNA oligonucleotide
aaactcgagattcagatttggatgtagcctg

SEQ ID NO: 8456 - DNA, 30 bp, Artificial Sequence
  Single strand DNA oligonucleotide
aaactcgagaatgcacaggcggagctatac

SEQ ID NO: 8457 - DNA, 34 bp, Artificial Sequence
  Single strand DNA oligonucleotide
aaaggtaccctaaattacgggcatagtcgaactg

SEQ ID NO: 8458 - DNA, 31 bp, Artificial Sequence
  Single strand DNA oligonucleotide
aaactcgagtatgaagaggtcagaggcaatg

SEQ ID NO: 8459 - DNA, 34 bp, Artificial Sequence
  Single strand DNA oligonucleotide
aaactcgagctagttaagagatgatggcaagtgg

SEQ ID NO: 8460 - DNA, 31 bp, Artificial Sequence
  Single strand DNA oligonucleotide
aaactcgagtagtgtataccgccgaccttac

SEQ ID NO: 8461 - DNA, 38 bp, Artificial Sequence
  Single strand DNA oligonucleotide
tttctcgagttatccagactctagagcttaagcaacac

SEQ ID NO: 8462 - DNA, 31 bp, Artificial Sequence
  Single strand DNA oligonucleotide
aaactcgagaagttgggcatatgtcaaagac

SEQ ID NO: 8463 - DNA, 31 bp, Artificial Sequence
  Single strand DNA oligonucleotide
aaaaggcctctaagcattgttcatccagtgc

SEQ ID NO: 8464 - DNA, 39 bp, Artificial Sequence
  Single strand DNA oligonucleotide
tttgaattcttacttgaaaccaagaatagcagcataaac

SEQ ID NO: 8465 - DNA, 35 bp, Artificial Sequence
  Single strand DNA oligonucleotide
aaactcgagccaaatatttcaattacaaaacagag

SEQ ID NO: 8466 - DNA, 30 bp, Artificial Sequence
  Single strand DNA oligonucleotide
aaagaattcaaagcaacccacacatcttac

SEQ ID NO: 8467 - DNA, 43 bp, Artificial Sequence
  Single strand DNA oligonucleotide
tttgaattcagagttttacttcacatctgtaaaactactaatc

SEQ ID NO: 8468 - DNA, 32 bp, Artificial Sequence
  Single strand DNA oligonucleotide
aaactcgaggggtgagcattatttcttctctc

SEQ ID NO: 8469 - DNA, 31 bp, Artificial Sequence
  Single strand DNA oligonucleotide
aaactcgagtgaaaacacgctcgactagatg

SEQ ID NO: 8470 - DNA, 30 bp, Artificial Sequence
  Single strand DNA oligonucleotide
aaagaattcaacatacatggccaaagacac

SEQ ID NO: 8471 - DNA, 32 bp, Artificial Sequence
  Single strand DNA oligonucleotide
aaaaggcctcacaatcttcttccagttacagc

SEQ ID NO: 8472 - DNA, 34 bp, Artificial Sequence
  Single strand DNA oligonucleotide
aaactcgagaggcaatacacacacaatttatcag

SEQ ID NO: 8473 - DNA, 34 bp, Artificial Sequence
  Single strand DNA oligonucleotide
aaaggtacctcgttaattgaaacacaactaaacc

SEQ ID NO: 8474 - DNA, 31 bp, Artificial Sequence
  Single strand DNA oligonucleotide
aaacccgggaaatggattcaacagagatggc

SEQ ID NO: 8475 - DNA, 39 bp, Artificial Sequence
  Single strand DNA oligonucleotide
tttaggcctctacaactactcagtttgtccacttaaagc

SEQ ID NO: 8476 - DNA, 39 bp, Artificial Sequence
  Single strand DNA oligonucleotide
aaaggtaccctaggaaacaacagaagaagaaattgtatc

SEQ ID NO: 8477 - DNA, 31 bp, Artificial Sequence
  Single strand DNA oligonucleotide
aaaggtacccatacaaacaatacccgatttc

SEQ ID NO: 8478 - DNA, 32 bp, Artificial Sequence
  Single strand DNA oligonucleotide
aaagaattcacgagcaagcaaagcatataaac

SEQ ID NO: 8479 - DNA, 31 bp, Artificial Sequence
  Single strand DNA oligonucleotide
tttctcgagttgctttgactggtatgcactc

SEQ ID NO: 8480 - DNA, 31 bp, Artificial Sequence
  Single strand DNA oligonucleotide
aaagaattctactccttgtcatcatcaatcg

SEQ ID NO: 8481 - DNA, 33 bp, Artificial Sequence
  Single strand DNA oligonucleotide
aaactcgagttggagcataggtgtctagatgtg

SEQ ID NO: 8482 - DNA, 31 bp, Artificial Sequence
  Single strand DNA oligonucleotide
aaactcgagagttatcgttgggactgatttc

SEQ ID NO: 8483 - DNA, 34 bp, Artificial Sequence
  Single strand DNA oligonucleotide
aaactcgagttccacagtaacatttactacaagg

SEQ ID NO: 8484 - DNA, 32 bp, Artificial Sequence
  Single strand DNA oligonucleotide
aaagaattcctaacaaatatcaacaggcccac

SEQ ID NO: 8485 - DNA, 31 bp, Artificial Sequence
  Single strand DNA oligonucleotide
aaaggatccaggtacaaatgtcaaggaggac

SEQ ID NO: 8486 - DNA, 31 bp, Artificial Sequence
  Single strand DNA oligonucleotide
aaagaattctcagtgttgcaatcatttaagc

SEQ ID NO: 8487 - DNA, 31 bp, Artificial Sequence
  Single strand DNA oligonucleotide
aaactcgaggttagggattgtgaaatcaatg

SEQ ID NO: 8488 - DNA, 31 bp, Artificial Sequence
  Single strand DNA oligonucleotide
aaactcgagatgtccacaaataaccaccaac

SEQ ID NO: 8489 - DNA, 39 bp, Artificial Sequence
  Single strand DNA oligonucleotide
aaagaattcctaagtactagcccatgtaactagatcaaa

SEQ ID NO: 8490 - DNA, 31 bp, Artificial Sequence
  Single strand DNA oligonucleotide
aaactcgagttacagcagggaaagaagtttg

SEQ ID NO: 8491 - DNA, 31 bp, Artificial Sequence
  Single strand DNA oligonucleotide
aaagaattcattctaccaccaaattctgtcc

SEQ ID NO: 8492 - DNA, 31 bp, Artificial Sequence
  Single strand DNA oligonucleotide
aaactcgaggagagatggaggtgaagtttgc

SEQ ID NO: 8493 - DNA, 35 bp, Artificial Sequence
  Single strand DNA oligonucleotide
tttctcgagtcactctcaaatgtcaattgcagtgt

SEQ ID NO: 8494 - DNA, 32 bp, Artificial Sequence
  Single strand DNA oligonucleotide
aaactcgagagttgaaattatgatcatcgacc

SEQ ID NO: 8495 - DNA, 36 bp, Artificial Sequence
  Single strand DNA oligonucleotide
aaagaattcctaattcatgctcgattctaaacaacg

SEQ ID NO: 8496 - DNA, 31 bp, Artificial Sequence
  Single strand DNA oligonucleotide
aaagaattctaactgcgagagaacacattgc

SEQ ID NO: 8497 - DNA, 31 bp, Artificial Sequence
  Single strand DNA oligonucleotide
aaactcgagcaagatcaatcccagtgtcaac

SEQ ID NO: 8498 - DNA, 31 bp, Artificial Sequence
  Single strand DNA oligonucleotide
aaactcgagtaccaacacaagaaggacacac

SEQ ID NO: 8499 - DNA, 31 bp, Artificial Sequence
  Single strand DNA oligonucleotide
aaactcgagtcgaagacatgttacattgagc

SEQ ID NO: 8500 - DNA, 32 bp, Artificial Sequence
  Single strand DNA oligonucleotide
aaactcgagcacggcatatctatttcaagctg

SEQ ID NO: 8501 - DNA, 31 bp, Artificial Sequence
  Single strand DNA oligonucleotide
aaagaattcgtagagcacaagtgggaaagac

SEQ ID NO: 8502 - DNA, 31 bp, Artificial Sequence
  Single strand DNA oligonucleotide
aaactcgagtccagatgaaacaccttctgtg

SEQ ID NO: 8503 - DNA, 36 bp, Artificial Sequence
  Single strand DNA oligonucleotide
aaactcgagtttaaacacacacgaagataataggca

SEQ ID NO: 8504 - DNA, 34 bp, Artificial Sequence
  Single strand DNA oligonucleotide
tttctcgaggtggttcggcatacagatttacttc

SEQ ID NO: 8505 - DNA, 32 bp, Artificial Sequence
  Single strand DNA oligonucleotide
aaactcgagttctgtctcatttaccactatgc

SEQ ID NO: 8506 - DNA, 34 bp, Artificial Sequence
  Single strand DNA oligonucleotide
aaactcgagctaaagaagaggatcagaggccaac

SEQ ID NO: 8507 - DNA, 34 bp, Artificial Sequence
  Single strand DNA oligonucleotide
aaactcgagaaccgttactttagctaccatcatc

SEQ ID NO: 8508 - DNA, 38 bp, Artificial Sequence
  Single strand DNA oligonucleotide
tttctcgagtcatcaaagcttcaagtacttggtaacag

SEQ ID NO: 8509 - DNA, 31 bp, Artificial Sequence
  Single strand DNA oligonucleotide
aaaaggcctctgactctaatgcacaagcaac

SEQ ID NO: 8510 - DNA, 31 bp, Artificial Sequence
  Single strand DNA oligonucleotide
aaactcgaggcacaacattagaactcgtcag

SEQ ID NO: 8511 - DNA, 33 bp, Artificial Sequence
  Single strand DNA oligonucleotide
aatgaattcgagaaaggaaatttcatcaaacac

SEQ ID NO: 8512 - DNA, 32 bp, Artificial Sequence
  Single strand DNA oligonucleotide
aaagatatcaattggtccattcctaaagagac

SEQ ID NO: 8513 - DNA, 31 bp, Artificial Sequence
  Single strand DNA oligonucleotide
aaactcgagcgacgatatcataatcttgcag

SEQ ID NO: 8514 - DNA, 33 bp, Artificial Sequence
  Single strand DNA oligonucleotide
tttgagctctcgacatgggaactgatatcattg

SEQ ID NO: 8515 - DNA, 37 bp, Artificial Sequence
  Single strand DNA oligonucleotide
tttctcgagtcaagattgaacctttatacttcatttc

SEQ ID NO: 8516 - DNA, 31 bp, Artificial Sequence
  Single strand DNA oligonucleotide
aaagaattcaacaggcaatgtagcaataacc

SEQ ID NO: 8517 - DNA, 31 bp, Artificial Sequence
  Single strand DNA oligonucleotide
aaactcgagattgcagatgaagacacaaatc

SEQ ID NO: 8518 - DNA, 34 bp, Artificial Sequence
  Single strand DNA oligonucleotide
aaaggtaccctacttggtgctatttacgttctgc

SEQ ID NO: 8519 - DNA, 35 bp, Artificial Sequence
  Single strand DNA oligonucleotide
aaagagctcctattgctcagattctaacagaaatg

SEQ ID NO: 8520 - DNA, 37 bp, Artificial Sequence
  Single strand DNA oligonucleotide
aaaggtaccctaaaagatttgcagatgtacaaagaag

SEQ ID NO: 8521 - DNA, 33 bp, Artificial Sequence
  Single strand DNA oligonucleotide
aaagaattcctattgcagtagaagacgaggttg

SEQ ID NO: 8522 - DNA, 35 bp, Artificial Sequence
  Single strand DNA oligonucleotide
aaagaattccaggttcatataactctcacacagtc

SEQ ID NO: 8523 - DNA, 31 bp, Artificial Sequence
  Single strand DNA oligonucleotide
aaaggtaccttaatgaggatgatgatgttgc

SEQ ID NO: 8524 - DNA, 32 bp, Artificial Sequence
  Single strand DNA oligonucleotide
aaagaattctccttggagtgaagttagagaag

SEQ ID NO: 8525 - DNA, 37 bp, Artificial Sequence
  Single strand DNA oligonucleotide
aaagaattcctatagactccaagtagctgtctttgtc

SEQ ID NO: 8526 - DNA, 33 bp, Artificial Sequence
  Single strand DNA oligonucleotide
aaaggtaccctaaaagaaatgcctgttgatctg

SEQ ID NO: 8527 - DNA, 31 bp, Artificial Sequence
  Single strand DNA oligonucleotide
aaactcgagcaacgatgactgcttgattaac

SEQ ID NO: 8528 - DNA, 31 bp, Artificial Sequence
  Single strand DNA oligonucleotide
aaatctagacagctcctgcaacttgagatac

SEQ ID NO: 8529 - DNA, 35 bp, Artificial Sequence
  Single strand DNA oligonucleotide
aaactcgagctactaacagcaccacataatgacag

SEQ ID NO: 8530 - DNA, 35 bp, Artificial Sequence
  Single strand DNA oligonucleotide
aaactcgagtctatgtctctctctccttcactaag

SEQ ID NO: 8531 - DNA, 32 bp, Artificial Sequence
  Single strand DNA oligonucleotide
aaactcgagggcttaaacacatgtcataccag

SEQ ID NO: 8532 - DNA, 36 bp, Artificial Sequence
  Single strand DNA oligonucleotide
aaaggtaccgaaaactatacacactctttctcttca

SEQ ID NO: 8533 - DNA, 37 bp, Artificial Sequence
  Single strand DNA oligonucleotide
tttgaattcttagttttaggggttaaccttgtgttcc

SEQ ID NO: 8534 - DNA, 35 bp, Artificial Sequence
  Single strand DNA oligonucleotide
aaactcgagctatttctgttcttgatcactcggac

SEQ ID NO: 8535 - DNA, 31 bp, Artificial Sequence
  Single strand DNA oligonucleotide
aaaggtaccttatatgtgccaataccacacc

SEQ ID NO: 8536 - DNA, 31 bp, Artificial Sequence
  Single strand DNA oligonucleotide
aaactcgagctgctcacgataattaatggac

SEQ ID NO: 8537 - DNA, 31 bp, Artificial Sequence
  Single strand DNA oligonucleotide
aaaggtaccttccgttggactaaattcagag

SEQ ID NO: 8538 - DNA, 31 bp, Artificial Sequence
  Single strand DNA oligonucleotide
aaactcgagggaactggtgaagaatttaagc

SEQ ID NO: 8539 - DNA, 32 bp, Artificial Sequence
  Single strand DNA oligonucleotide
aaagaattccaaaccacattctctcatgtttc

SEQ ID NO: 8540 - DNA, 31 bp, Artificial Sequence
  Single strand DNA oligonucleotide
tttggtaccgatggagaaggcaatcttgatg

SEQ ID NO: 8541 - DNA, 29 bp, Artificial Sequence
  Single strand DNA oligonucleotide
aaaggtaccgagattgatcacattgctgc

SEQ ID NO: 8542 - DNA, 33 bp, Artificial Sequence
  Single strand DNA oligonucleotide
aaaggtaccctaagtgcattcatattttcctgg

SEQ ID NO: 8543 - DNA, 31 bp, Artificial Sequence
  Single strand DNA oligonucleotide
aaaggtaccaaatcaattccgtaccaacaac

SEQ ID NO: 8544 - DNA, 31 bp, Artificial Sequence
  Single strand DNA oligonucleotide
aaaggtaccttcaccaacttatacgaaccac

SEQ ID NO: 8545 - DNA, 31 bp, Artificial Sequence
  Single strand DNA oligonucleotide
tttctcgagtttggctcaacaacaacatttc

SEQ ID NO: 8546 - DNA, 34 bp, Artificial Sequence
  Single strand DNA oligonucleotide
aaagaattccgaaagtgttcatgatttatctcac

SEQ ID NO: 8547 - DNA, 30 bp, Artificial Sequence
  Single strand DNA oligonucleotide
aaactcgagttcaacggtttgattcatctg

SEQ ID NO: 8548 - DNA, 34 bp, Artificial Sequence
  Single strand DNA oligonucleotide
tttctcgagcattagcatcaaccaaaccatacac

SEQ ID NO: 8549 - DNA, 31 bp, Artificial Sequence
  Single strand DNA oligonucleotide
aaactcgagatctgaatctcaaagccactcg

SEQ ID NO: 8550 - DNA, 31 bp, Artificial Sequence
  Single strand DNA oligonucleotide
aaactcgagtctagtggataaattggccgac

SEQ ID NO: 8551 - DNA, 30 bp, Artificial Sequence
  Single strand DNA oligonucleotide
aaactcgagttccaaaggaagatctggtcc

SEQ ID NO: 8552 - DNA, 35 bp, Artificial Sequence
  Single strand DNA oligonucleotide
aaactcgagctagaggagaccataaccagtagtcc

SEQ ID NO: 8553 - DNA, 31 bp, Artificial Sequence
  Single strand DNA oligonucleotide
aaaggtacccaacatgctaagtgcctgtgac

SEQ ID NO: 8554 - DNA, 34 bp, Artificial Sequence
  Single strand DNA oligonucleotide
aaagaattcctatagaatatggtgtggctgatca

SEQ ID NO: 8555 - DNA, 31 bp, Artificial Sequence
  Single strand DNA oligonucleotide
aaagaattcagtgatcacatctcactgccac

SEQ ID NO: 8556 - DNA, 31 bp, Artificial Sequence
  Single strand DNA oligonucleotide
aaagagctctaatccttgaccactcgaaatc

SEQ ID NO: 8557 - DNA, 30 bp, Artificial Sequence
  Single strand DNA oligonucleotide
aaaggtacctaaccttgtttaacggccaac

SEQ ID NO: 8558 - DNA, 31 bp, Artificial Sequence
  Single strand DNA oligonucleotide
aaactcgagatacaagcacctaagtgggctg

SEQ ID NO: 8559 - DNA, 31 bp, Artificial Sequence
  Single strand DNA oligonucleotide
aaagaattcactacaatccgggtacatcaag

SEQ ID NO: 8560 - DNA, 31 bp, Artificial Sequence
  Single strand DNA oligonucleotide
aaagaattcaagtaggagtcggcaggtaaag

SEQ ID NO: 8561 - DNA, 29 bp, Artificial Sequence
  Single strand DNA oligonucleotide
aaaggtaccaccaaatactgccagtggtg

SEQ ID NO: 8562 - DNA, 28 bp, Artificial Sequence
  Single strand DNA oligonucleotide
aaactcgagttcgaaccaaccaatgaac

SEQ ID NO: 8563 - DNA, 31 bp, Artificial Sequence
  Single strand DNA oligonucleotide
aaactcgaggacaaatcccaaatatcacagg

SEQ ID NO: 8564 - DNA, 31 bp, Artificial Sequence
  Single strand DNA oligonucleotide
aaaggtacctgtccatgagatccaatttacc

SEQ ID NO: 8565 - DNA, 31 bp, Artificial Sequence
  Single strand DNA oligonucleotide
aaaggatccaacagatgaagaaagacactgc

SEQ ID NO: 8566 - DNA, 30 bp, Artificial Sequence
  Single strand DNA oligonucleotide
aaaggtacccggattggacttgaaacattg

SEQ ID NO: 8567 - DNA, 31 bp, Artificial Sequence
  Single strand DNA oligonucleotide
aaaggtacctagtagatgcagacgcattcag

SEQ ID NO: 8568 - DNA, 32 bp, Artificial Sequence
  Single strand DNA oligonucleotide
aaaggatcctcaacacattaagcagacacagc

SEQ ID NO: 8569 - DNA, 28 bp, Artificial Sequence
  Single strand DNA oligonucleotide
aaactcgagcaaattctgtcgaacgagc

SEQ ID NO: 8570 - DNA, 36 bp, Artificial Sequence
  Single strand DNA oligonucleotide
tttgaattccaactatttacatcgttctcttgtctc

SEQ ID NO: 8571 - DNA, 30 bp, Artificial Sequence
  Single strand DNA oligonucleotide
aaactcgaggagcatcataatcaccaccac

SEQ ID NO: 8572 - DNA, 38 bp, Artificial Sequence
  Single strand DNA oligonucleotide
tttctcgagttaagcatcatgtttatggaagtatttga

SEQ ID NO: 8573 - DNA, 31 bp, Artificial Sequence
  Single strand DNA oligonucleotide
aaagaattccgtatcagatgtgatgccagtc

SEQ ID NO: 8574 - DNA, 31 bp, Artificial Sequence
  Single strand DNA oligonucleotide
aaactcgagtataaaacatgcagaaacgagg

SEQ ID NO: 8575 - DNA, 30 bp, Artificial Sequence
  Single strand DNA oligonucleotide
tttctcgagcatagcactgcctctagcctg

SEQ ID NO: 8576 - DNA, 29 bp, Artificial Sequence
  Single strand DNA oligonucleotide
aaactcgagatttattgattggtggcgag

SEQ ID NO: 8577 - DNA, 31 bp, Artificial Sequence
  Single strand DNA oligonucleotide
aaactcgaggcttaataatacctcgccaaag

SEQ ID NO: 8578 - DNA, 32 bp, Artificial Sequence
  Single strand DNA oligonucleotide
aaaggtaccatttatccacacaaagacaaacc

SEQ ID NO: 8579 - DNA, 33 bp, Artificial Sequence
  Single strand DNA oligonucleotide
aaactcgagctaaagggtaactttctcccgttc

SEQ ID NO: 8580 - DNA, 28 bp, Artificial Sequence
  Single strand DNA oligonucleotide
aaagaattccacaattgcaaggctcctg

SEQ ID NO: 8581 - DNA, 35 bp, Artificial Sequence
  Single strand DNA oligonucleotide
aaactcgagaacctgtatatttcattcaatttgtg

SEQ ID NO: 8582 - DNA, 31 bp, Artificial Sequence
  Single strand DNA oligonucleotide
aaagaattccagtgaaagactccgacaaatc

SEQ ID NO: 8583 - DNA, 34 bp, Artificial Sequence
  Single strand DNA oligonucleotide
aaactcgagcgaagacagatatgtacaatgagag

SEQ ID NO: 8584 - DNA, 31 bp, Artificial Sequence
  Single strand DNA oligonucleotide
aaactcgagagacaacacacgagaagctaag

SEQ ID NO: 8585 - DNA, 35 bp, Artificial Sequence
  Single strand DNA oligonucleotide
tttctcgagcaattacggaaacaatattcatcatc

SEQ ID NO: 8586 - DNA, 31 bp, Artificial Sequence
  Single strand DNA oligonucleotide
aaactcgagtgaaattcaggagactgttgtg

SEQ ID NO: 8587 - DNA, 31 bp, Artificial Sequence
  Single strand DNA oligonucleotide
aaactcgagaaacccaacaatccaacattac

SEQ ID NO: 8588 - DNA, 29 bp, Artificial Sequence
  Single strand DNA oligonucleotide
ttcggatcctcgcatgaagaccagttacg

SEQ ID NO: 8589 - DNA, 36 bp, Artificial Sequence
  Single strand DNA oligonucleotide
aaagtcgacctagggtacaacactatagcacgaacc

SEQ ID NO: 8590 - DNA, 31 bp, Artificial Sequence
  Single strand DNA oligonucleotide
aaactcgagaatgcacttaaggacatggaag

SEQ ID NO: 8591 - DNA, 31 bp, Artificial Sequence
  Single strand DNA oligonucleotide
aaactcgagtcaatgtcatggctctttattg

SEQ ID NO: 8592 - DNA, 31 bp, Artificial Sequence
  Single strand DNA oligonucleotide
aaactcgagcaatccaacaataaatgaaacg

SEQ ID NO: 8593 - DNA, 31 bp, Artificial Sequence
  Single strand DNA oligonucleotide
aaactcgaggaggttcacagattcagacaag

SEQ ID NO: 8594 - DNA, 31 bp, Artificial Sequence
  Single strand DNA oligonucleotide
aaaggtaccaaatctgagtgttgagacgagc

SEQ ID NO: 8595 - DNA, 30 bp, Artificial Sequence
  Single strand DNA oligonucleotide
aaactcgagccataaatgggagaagattgg

SEQ ID NO: 8596 - DNA, 31 bp, Artificial Sequence
  Single strand DNA oligonucleotide
aaactcgagtagcttggaaacttcaacaaac

SEQ ID NO: 8597 - DNA, 29 bp, Artificial Sequence
  Single strand DNA oligonucleotide
aaactcgagtctccagcttcgagagtttc

SEQ ID NO: 8598 - DNA, 31 bp, Artificial Sequence
  Single strand DNA oligonucleotide
aaaggtaccaatacccagatggttcacagag

SEQ ID NO: 8599 - DNA, 30 bp, Artificial Sequence
  Single strand DNA oligonucleotide
aaaggtaccaaatgttgcaatgttgtgaag

SEQ ID NO: 8600 - DNA, 33 bp, Artificial Sequence
  Single strand DNA oligonucleotide
aaactcgaggcagatgatggaagataactagag

SEQ ID NO: 8601 - DNA, 31 bp, Artificial Sequence
  Single strand DNA oligonucleotide
aaactcgagcaaatgatatcagaaacgcagc

SEQ ID NO: 8602 - DNA, 31 bp, Artificial Sequence
  Single strand DNA oligonucleotide
aaactcgagaaatgttgctacgacggaatac

SEQ ID NO: 8603 - DNA, 32 bp, Artificial Sequence
  Single strand DNA oligonucleotide
aaactcgagggaccattccatttctacatagg

SEQ ID NO: 8604 - DNA, 31 bp, Artificial Sequence
  Single strand DNA oligonucleotide
aaactcgagtgttgttacttgcaccaagtcc

SEQ ID NO: 8605 - DNA, 32 bp, Artificial Sequence
  Single strand DNA oligonucleotide
aaactcgagattctgtcaaagcaaagacaaac

SEQ ID NO: 8606 - DNA, 32 bp, Artificial Sequence
  Single strand DNA oligonucleotide
aaactcgagaaatatagtgtataccgccgacc

SEQ ID NO: 8607 - DNA, 35 bp, Artificial Sequence
  Single strand DNA oligonucleotide
tttctcgagttatctagcacaaaatgcagagacag

SEQ ID NO: 8608 - DNA, 31 bp, Artificial Sequence
  Single strand DNA oligonucleotide
aaactcgagaacaagcgtttgaccaaataac

SEQ ID NO: 8609 - DNA, 31 bp, Artificial Sequence
  Single strand DNA oligonucleotide
aaactcgagcaaaacgatttaggttaggtgc

SEQ ID NO: 8610 - DNA, 31 bp, Artificial Sequence
  Single strand DNA oligonucleotide
aaagaattctgccaacgagaagaaactttac

SEQ ID NO: 8611 - DNA, 30 bp, Artificial Sequence
  Single strand DNA oligonucleotide
aaactcgagagcagacagctttgattgatg

SEQ ID NO: 8612 - DNA, 30 bp, Artificial Sequence
  Single strand DNA oligonucleotide
aaactcgaggtgggtgagcattatttcttc

SEQ ID NO: 8613 - DNA, 35 bp, Artificial Sequence
  Single strand DNA oligonucleotide
tttggatccttacttgagaggtaaggagctgtgtg

SEQ ID NO: 8614 - DNA, 31 bp, Artificial Sequence
  Single strand DNA oligonucleotide
aaactcgagttgaagaacaaaagcgtgaatg

SEQ ID NO: 8615 - DNA, 31 bp, Artificial Sequence
  Single strand DNA oligonucleotide
aaaggtacccatcctcatgaacaatgatgtc

SEQ ID NO: 8616 - DNA, 32 bp, Artificial Sequence
  Single strand DNA oligonucleotide
aaaggtaccgcggggaacaaacatagtaatag

SEQ ID NO: 8617 - DNA, 32 bp, Artificial Sequence
  Single strand DNA oligonucleotide
aaaaggcctcaaatgagtagaatttgcatgtg

SEQ ID NO: 8618 - DNA, 31 bp, Artificial Sequence
  Single strand DNA oligonucleotide
aaactcgaggaatcttgacctccaagcacac

SEQ ID NO: 8619 - DNA, 33 bp, Artificial Sequence
  Single strand DNA oligonucleotide
tttgagctccatagcaaggacactccagtagag

SEQ ID NO: 8620 - DNA, 32 bp, Artificial Sequence
  Single strand DNA oligonucleotide
aaagaattccatccttacaaaccattttcgtc

SEQ ID NO: 8621 - DNA, 32 bp, Artificial Sequence
  Single strand DNA oligonucleotide
aaaggtaccgccagaacataaatcgttaattg

SEQ ID NO: 8622 - DNA, 30 bp, Artificial Sequence
  Single strand DNA oligonucleotide
aaacccgggtgatacaatttcatccgcgac

SEQ ID NO: 8623 - DNA, 33 bp, Artificial Sequence
  Single strand DNA oligonucleotide
aaactcgagcattggaaacaggaagcaaattac

SEQ ID NO: 8624 - DNA, 36 bp, Artificial Sequence
  Single strand DNA oligonucleotide
tttctcgagtcaataatcactttcattcaccaattc

SEQ ID NO: 8625 - DNA, 31 bp, Artificial Sequence
  Single strand DNA oligonucleotide
aaaggtacctcaaagtgtcatgttcaaatcg

SEQ ID NO: 8626 - DNA, 34 bp, Artificial Sequence
  Single strand DNA oligonucleotide
tttctcgagttccttatcctctgttctacattgc

SEQ ID NO: 8627 - DNA, 34 bp, Artificial Sequence
  Single strand DNA oligonucleotide
aaagaattcgtatctttaaccacaagagacagtg

SEQ ID NO: 8628 - DNA, 31 bp, Artificial Sequence
  Single strand DNA oligonucleotide
aaactcgagtctgcaaggctaggaagctatg

SEQ ID NO: 8629 - DNA, 32 bp, Artificial Sequence
  Single strand DNA oligonucleotide
aaactcgaggaggagattagcgtacaactctg

SEQ ID NO: 8630 - DNA, 33 bp, Artificial Sequence
  Single strand DNA oligonucleotide
aaagaattcctgtgttgcttcattcaattattc

SEQ ID NO: 8631 - DNA, 34 bp, Artificial Sequence
  Single strand DNA oligonucleotide
tttctcgagtccgattacagtgtaaatgttgaac

SEQ ID NO: 8632 - DNA, 31 bp, Artificial Sequence
  Single strand DNA oligonucleotide
aaaggatcctaggagttgctaccaatttcac

SEQ ID NO: 8633 - DNA, 31 bp, Artificial Sequence
  Single strand DNA oligonucleotide
aaagaattcaagagactgagctttgtcagtg

SEQ ID NO: 8634 - DNA, 32 bp, Artificial Sequence
  Single strand DNA oligonucleotide
aaactcgaggagaaatctcacatccactaagc

SEQ ID NO: 8635 - DNA, 33 bp, Artificial Sequence
  Single strand DNA oligonucleotide
tttctcgagtgcatatggttttacacgtcaatg

SEQ ID NO: 8636 - DNA, 31 bp, Artificial Sequence
  Single strand DNA oligonucleotide
aaactcgaggcttgataataattgcctttgc

SEQ ID NO: 8637 - DNA, 35 bp, Artificial Sequence
  Single strand DNA oligonucleotide
aaactcgagtcatattcttacaaagttacagcagg

SEQ ID NO: 8638 - DNA, 31 bp, Artificial Sequence
  Single strand DNA oligonucleotide
aaagaattctctaaatgagcattctaccacc

SEQ ID NO: 8639 - DNA, 31 bp, Artificial Sequence
  Single strand DNA oligonucleotide
aaactcgagatggagtcagatgagttcccag

SEQ ID NO: 8640 - DNA, 32 bp, Artificial Sequence
  Single strand DNA oligonucleotide
aaactcgagtcactccaagggaaatcaacacc

SEQ ID NO: 8641 - DNA, 39 bp, Artificial Sequence
  Single strand DNA oligonucleotide
aaactcgagtcatgagagaatagtaaactttgttgcctc

SEQ ID NO: 8642 - DNA, 31 bp, Artificial Sequence
  Single strand DNA oligonucleotide
aaaggtaccataggaagtgcattaagcttgg

SEQ ID NO: 8643 - DNA, 32 bp, Artificial Sequence
  Single strand DNA oligonucleotide
aaactcgaggtttgaggagatttcacactttg

SEQ ID NO: 8644 - DNA, 32 bp, Artificial Sequence
  Single strand DNA oligonucleotide
aaagaattcctcacgctctactctgaacaatg

SEQ ID NO: 8645 - DNA, 31 bp, Artificial Sequence
  Single strand DNA oligonucleotide
aaactcgagtctttcaaggaagaatgtttgc

SEQ ID NO: 8646 - DNA, 31 bp, Artificial Sequence
  Single strand DNA oligonucleotide
aaagaattcaacacattgcaataactgcgag

SEQ ID NO: 8647 - DNA, 32 bp, Artificial Sequence
  Single strand DNA oligonucleotide
aaactcgagagcagtatcaagatcaatcccag

SEQ ID NO: 8648 - DNA, 29 bp, Artificial Sequence
  Single strand DNA oligonucleotide
aaaggtaccagaattcaggcaatgcaaac

SEQ ID NO: 8649 - DNA, 35 bp, Artificial Sequence
  Single strand DNA oligonucleotide
aaactcgagctatgatgatgaagtgacacgttctg

SEQ ID NO: 8650 - DNA, 31 bp, Artificial Sequence
  Single strand DNA oligonucleotide
aaactcgaggaaacttcatttgaacgaaacg

SEQ ID NO: 8651 - DNA, 31 bp, Artificial Sequence
  Single strand DNA oligonucleotide
aaactcgagttgtgtattagccagcatgaag

SEQ ID NO: 8652 - DNA, 31 bp, Artificial Sequence
  Single strand DNA oligonucleotide
aaagaattcatctaatgcaggaacaaacagg

SEQ ID NO: 8653 - DNA, 31 bp, Artificial Sequence
  Single strand DNA oligonucleotide
aaagaattctgaggaagggttagagtgaaac

SEQ ID NO: 8654 - DNA, 35 bp, Artificial Sequence
  Single strand DNA oligonucleotide
tttctcgagtcaaaagcttcacacaattgaccaag

SEQ ID NO: 8655 - DNA, 32 bp, Artificial Sequence
  Single strand DNA oligonucleotide
aaactcgagcacacacctcaactaatttcacg

SEQ ID NO: 8656 - DNA, 31 bp, Artificial Sequence
  Single strand DNA oligonucleotide
aaagaattcaaagtactaatcgcttccctgc

SEQ ID NO: 8657 - DNA, 31 bp, Artificial Sequence
  Single strand DNA oligonucleotide
aaactcgaggcacggaaatttgaattaatcg

SEQ ID NO: 8658 - DNA, 32 bp, Artificial Sequence
  Single strand DNA oligonucleotide
tttctcgagtgttgatcaccgaacaaccttac

SEQ ID NO: 8659 - DNA, 30 bp, Artificial Sequence
  Single strand DNA oligonucleotide
aaactcgagcagtaattacagcccctccga

SEQ ID NO: 8660 - DNA, 35 bp, Artificial Sequence
  Single strand DNA oligonucleotide
tttctcgagctgcatgtcctctatacgtagacaag

SEQ ID NO: 8661 - DNA, 32 bp, Artificial Sequence
  Single strand DNA oligonucleotide
aaactcgagcatgcccttcaactagtacaatc

SEQ ID NO: 8662 - DNA, 31 bp, Artificial Sequence
  Single strand DNA oligonucleotide
aaactcgagggcttgaaggatattgtgatgg

SEQ ID NO: 8663 - DNA, 31 bp, Artificial Sequence
  Single strand DNA oligonucleotide
aaaaggcctcaacatagcgtggatactcatc

SEQ ID NO: 8664 - DNA, 31 bp, Artificial Sequence
  Single strand DNA oligonucleotide
aaactcgagtcgaaccatacataagaagctg

SEQ ID NO: 8665 - DNA, 31 bp, Artificial Sequence
  Single strand DNA oligonucleotide
aaagaattcaacatcagtcgctcatgtcatc

SEQ ID NO: 8666 - DNA, 31 bp, Artificial Sequence
  Single strand DNA oligonucleotide
aaaaggcctctcctgaaattagtcaaggtgc

SEQ ID NO: 8667 - DNA, 36 bp, Artificial Sequence
  Single strand DNA oligonucleotide
aaactcgaggatagagatatcatgcatagacacagg

SEQ ID NO: 8668 - DNA, 31 bp, Artificial Sequence
  Single strand DNA oligonucleotide
aaactcgagcacatacaggtgaagacagagg

SEQ ID NO: 8669 - DNA, 33 bp, Artificial Sequence
  Single strand DNA oligonucleotide
aatgaattccaaatgctagtagaagaagaccac

SEQ ID NO: 8670 - DNA, 33 bp, Artificial Sequence
  Single strand DNA oligonucleotide
aaagatatctcttaattatgttgcaatgtccag

SEQ ID NO: 8671 - DNA, 31 bp, Artificial Sequence
  Single strand DNA oligonucleotide
aaactcgagtaacattcagcaatgacaccac

SEQ ID NO: 8672 - DNA, 33 bp, Artificial Sequence
  Single strand DNA oligonucleotide
aaaggtaccctgttacaaacctctgaaacaaac

SEQ ID NO: 8673 - DNA, 31 bp, Artificial Sequence
  Single strand DNA oligonucleotide
aaactcgagcatgcttaattagggtacgacg

SEQ ID NO: 8674 - DNA, 31 bp, Artificial Sequence
  Single strand DNA oligonucleotide
aaactcgagaactgccaaccaggtcataaac

SEQ ID NO: 8675 - DNA, 31 bp, Artificial Sequence
  Single strand DNA oligonucleotide
aaactcgaggaagtcacaagaggaaatctgc

SEQ ID NO: 8676 - DNA, 31 bp, Artificial Sequence
  Single strand DNA oligonucleotide
aaactcgagttccaacaatgtgaagagtgag

SEQ ID NO: 8677 - DNA, 35 bp, Artificial Sequence
  Single strand DNA oligonucleotide
aaaggtaccctatagcttccatatattcttggtgc

SEQ ID NO: 8678 - DNA, 34 bp, Artificial Sequence
  Single strand DNA oligonucleotide
aaagagctcacaatccgactttataactcttgac

SEQ ID NO: 8679 - DNA, 36 bp, Artificial Sequence
  Single strand DNA oligonucleotide
aaactcgaggcatcacatagtacacaagagaactca

SEQ ID NO: 8680 - DNA, 34 bp, Artificial Sequence
  Single strand DNA oligonucleotide
aaagaattcctaatgcctttgtgctaagtgtacc

SEQ ID NO: 8681 - DNA, 36 bp, Artificial Sequence
  Single strand DNA oligonucleotide
aaagaattccatttaacaggttcatataactctcac

SEQ ID NO: 8682 - DNA, 31 bp, Artificial Sequence
  Single strand DNA oligonucleotide
aaaggtaccaacaaatcttgcttgaagtgtg

SEQ ID NO: 8683 - DNA, 30 bp, Artificial Sequence
  Single strand DNA oligonucleotide
aaagaattctaaagctgtgtccttggagtg

SEQ ID NO: 8684 - DNA, 31 bp, Artificial Sequence
  Single strand DNA oligonucleotide
aaaggtacctcgactttcgattacacaagag

SEQ ID NO: 8685 - DNA, 31 bp, Artificial Sequence
  Single strand DNA oligonucleotide
aaactcgagatcctcaggccctctaaataac

SEQ ID NO: 8686 - DNA, 32 bp, Artificial Sequence
  Single strand DNA oligonucleotide
aaactcgagttaatgcatccaaatctaacagc

SEQ ID NO: 8687 - DNA, 33 bp, Artificial Sequence
  Single strand DNA oligonucleotide
aaactcgagggtctatgtctctctctccttcac

SEQ ID NO: 8688 - DNA, 32 bp, Artificial Sequence
  Single strand DNA oligonucleotide
aaactcgagaaacacaccataggcttaaacac

SEQ ID NO: 8689 - DNA, 30 bp, Artificial Sequence
  Single strand DNA oligonucleotide
aaagaattcaaacataaccggtccaggaac
